(12) United States Patent
Bakker et al.

(10) Patent No.: US 7,820,790 B2
(45) Date of Patent: *Oct. 26, 2010

(54) IL-6 BINDING PROTEINS

(75) Inventors: Alice Bakker, Cupertino, CA (US);
Amy N. Duguay, Saratoga, CA (US);
Qiang Liu, Foster City, CA (US);
Joshua Silverman, Sunnyvale, CA (US);
Kevin Moore, Palo Alto, CA (US)

(73) Assignee: Amgen Mountain View Inc., Thousand Oaks, CA (US)

( * ) Notice: Subject to any disclaimer, the term of this patent is extended or adjusted under 35 U.S.C. 154(b) by 830 days.

This patent is subject to a terminal disclaimer.

(21) Appl. No.: 11/655,776

(22) Filed: Jan. 18, 2007

(65) Prior Publication Data

US 2009/0305962 A1 Dec. 10, 2009

Related U.S. Application Data

(63) Continuation-in-part of application No. 11/486,246, filed on Jul. 12, 2006.

(60) Provisional application No. 60/699,137, filed on Jul. 13, 2005.

(51) Int. Cl.
*C07K 14/00* (2006.01)
*C07K 17/00* (2006.01)

(52) U.S. Cl. .................... 530/350; 530/402

(58) Field of Classification Search ............. None
See application file for complete search history.

(56) References Cited

FOREIGN PATENT DOCUMENTS

WO WO 02/088171 A3 11/2002
WO WO 2005/040229 A2 5/2005

OTHER PUBLICATIONS

Mackiewiez et al., Soluble human interleukin-6-receptor modulates interleukin-6-dependent N-glycosylation of alpha-one-protease inhibitor secreted by HepG2 cells, Federation of European Biochemical Societies, Jul. 1992, No. 2, 3, pp. 257-261.

*Primary Examiner*—Prema Mertz
(74) *Attorney, Agent, or Firm*—Charles K. Sholtz

(57) ABSTRACT

Polypeptides comprising monomer domains that bind to IL-6, or portions thereof, are provided.

27 Claims, 16 Drawing Sheets

Figure 1

LDL-receptor class A domain

```
LRP1_HUMAN    C.EPYQFRCKNNR......CVPGRWQ.CDYDNDCGDNSDEES.....C
LRP1_HUMAN    C.LPSQFKCTNTNR.....CIPGIFR.CNGQDNCGDGEDERD.....C
LDLR_HUMAN    C.SQDEFRCHDGK......CISRQFV.CDSDRDCLDGSDEAS.....C
LRP2_HUMAN    C.SSSAFTCGHGE......CIPAHWR.CDKRNDCVDGSDEHN.....C
LRP2_HUMAN    C.SSSEFQCASGR......CIPQHWY.CDQETDCFDASDEPAS....C
CORI_HUMAN    CHSQGLVECRNGQ......CIPSTFQ.CDGDEDCKDGSDEEN.....C
MAT_HUMAN     C.PAQTFRCSNGK......CLSKSQQ.CNGKDDCGDGSDEAS.....C
CO8B_HUMAN    C...EGFVCAQTGR.....CVNRRLL.CNGDNDCGDQSDEAN.....C
MAT_HUMAN     C.TKHTYRCLNGL......CLSKGNPECDGKEDCSDGSDEKD.....C
LDVR_HUMAN    CLGPGKFKCRSGE......CIDISKV.CNQEQDCRDWSDEPLKE..C
APOER2_HUM    C.PAEKLSCGPTSHK....CVPASWR.CDGEKDCEGGADEAG.....C
SORL_HUMAN    CTHFMDFVCKNRQQ.....CLFHSMV.CDGIIQCRDGSDEDAAFAGC
ST7_HUMAN     C.AYNQFQCLSRFTKVYTCLPESLK.CDGNIDCLDLGDEID.....C
                                              *  *  **
consensus     C.1234F6C12G4......CI23456.CDG34DC1D3SDE78.....C
```

Figure 3

Ligands recognized by naturally-occurring LDL-receptor family

*proteases*
- factor IXa
- pro-uPA
- t-PA
- plasminogen
- MMP-9

*inhibitors*
- $\alpha_2$-macroglobulin
- PAI-1
- TFPI
- pancreatic trypsin inhibitor

*complexes*
- protease/
  - $\alpha_1$-antitrypsin
  - protein C inhibitor
  - protease nexin-1
  - antithrombin
  - C1-inhibitor
- thrombin/heparin cofactor II
- cathepsin G/$\alpha_1$-antichymotrypsin

*vitamin-carrier complexes*
- vitamin D-bp, vitamin D
- retinol-bp, vitamin A
- transcobalamin, vitamin B12

*proteins involved in lipoprotein metabolism*
- apoB100
- apoE
- apoJ (clusterin)
- apoH ($\beta_2$-glycoprotein I)
- Lp(a)
- hepatic lipase
- lipoprotein lipase
- IDL
- VLDL
- $\beta$-VLDL

*non-human*
- pseudomonas exotoxin A
- circumsporozoite protein
- trichosanthin
- ricin A
- saporin

*antibiotics*
- gentamicin
- polymyxin B

*viruses*
- HRV2 (Rhino)
- HCV (Flavi)
- BVDV (Flavi)

*miscellaneous*
- albumin
- transthyretin
- $\beta$-Amyloid precursor protein
- RAP
- complement C3
- lactoferrin
- thyroglobulin
- thrombospondin
- saposin precursor
- reelin
- insulin
- parathyroid hormone (PTH)
- aprotinin
- $\alpha$-amylase
- C1q
- $\alpha_1$-microglobulin
- $\beta_2$-microglobulin
- odorant-binding protein
- epidermal growth factor
- prolactin
- lysozyme
- connective tissue growth factor (CTGF)
- cytochrome c
- seminal vesicle secretory protein II
- clara cell secretory protein (CCSP)
- cubulin
- factor VIII

Figure 6

```
                        a           b c                    de    f ghi  jk lm          nop          q
IDD_HUMAN      C.........NPGQFACRSGTIQ..........CIPLPWQ.CDGWATCEDE......SDEAN......C
LRP3_HUMAN     C.........QADEFRCDNGK...........CLPGPWQ.CNTVDECGDG......SDEGN......C
LRP3_HUMAN     C.........PGGTFPCSGARSTR........CLPVERR.CDGLQDCGDG......SDEAG......C
LRP3_HUMAN     C.........LPWEQPCGSSSDSDGGSLGDQGCFSEPQR.CDGWWHCASG......RDEQG......C
LRP3_HUMAN     C.........PPDQYPCEGGSGL.........CYTPADR.CNNQKSCPDG......ADEKN......C
LRP3_HUMAN     C.........QPGTFHCGTNL...........CIFETWR.CDGQEDCQDG......SDEHG......C
LRP5_HUMAN     C.........SPDQFACATGEID.........CIPGAWR.CDGFPECDDQ......SDEEG......C
LRP5_HUMAN     C.........SAAQFPCARGQ...........CVDLRLR.CDGEADCQDR......SDEVD......C
LRP5_HUMAN     C.........LPNQFRCASGQ...........CVLIKQQ.CDSFPDCIDG......SDELM......C
LRP6_HUMAN     C.........SPQQFTCFTGEID.........CIPVAWR.CDGFTECEDH......SDELN......C
LRP6_HUMAN     C.........SESQFQCASGQ...........CIDGALR.CNGDANCQDK......SDEKN......C
LRP6_HUMAN     C.........LIDQFRCANGQ...........CIGKHKK.CDHNVDCSDK......SDELD......C
ST7_HUMAN      C.........ACDQFRCGNGK...........CIPEAWK.CNNMDECGDS......SDEEI......C
ST7_HUMAN      C.........AYNQFQCLSRFTKVYT......CLPESLK.CDGNIDCLDL......GDEID......C
ST7_HUMAN      C.........LPWEIPCGGNWG..........CYTEQQR.CDGYWHCPNG......RDETN......C
ST7_HUMAN      C.........QKEEFPCSRNGV..........CYPRSDR.CNYQNHCPNG......SDEKN......C
ST7_HUMAN      C.........QPGNFHCKNNR...........CVFESWV.CDSQDDCGDG......SDEEN......C
CORI_HUMAN     C.........GRGENFLCASGI..........CIPGKLQ.CNGYNDCDDW......SDEAH......C
CORI_HUMAN     C.........SENLFHCHTGK...........CLNYSLV.CDGYDDCGDL......SDEQN......C
CORI_HUMAN     C.........NPTTEHRCGDGR..........CIAMEWV.CDGDHDCVDK......SDEVN......C
CORI_HUMAN     C.........HSQGLVECRNGQ..........CIPSTFQ.CDGDEDCKDG......SDEEN......C
CORI_HUMAN     C.........SPSHFKCRSGQ...........CVLASRR.CDGQADCDDD......SDEEN......C
CORI_HUMAN     C.........KERDLWECPSNKQ.........CLKHTVI.CDGFPDCPDY......MDEKN......C
CORI_HUMAN     C.........QDDELECANHA...........CVSRDLW.CDGEADCSDS......SDEWD......C
TMS2_HUMAN     C.........SNSGIECDSSGT..........CINPSNW.CDGVSHCPGG......EDENR......C
TMS3_HUMAN     C.........SGKYRCRSSFK...........CIELIAR.CDGVSDCKDG......EDEYR......C
MAT_HUMAN      C.........PGQFTCRTGR............CIRKELR.CDGWADCTDH......SDELN......C
MAT_HUMAN      C.........DAGHQFTCKNKF..........CKPLFWV.CDSVNDCGDN......SDEQG......C
MAT_HUMAN      C.........PAQTFRCSNGK...........CLSKSQQ.CNGKDDCGDG......SDEAS......C
MAT_HUMAN      C.........TKHTYRCLNGL...........CLSKGNPECDGKEDCSDG......SDEKD......C
ENTK_HUMAN     C..........LPGSSPCTDALT.........CIKADLF.CDGEVNCPDG......SDEDNKM....C
ENTK_HUMAN     C.........KADHFQCKNGE...........CVPLVNL.CDGHLHCEDG......SDEAD......C
HAI1_HUMAN     C.........QPTQFRCSNGC...........CIDSFLE.CDDTPNCPDA......SDEAA......C
CFAI_HUMAN     C.YTQKADSPMDDFFQCVNGK...........YISQMKA.CDGINDCGDQ......SDEL.......C
CFAI_HUMAN     C.........QGKGFHCKSGV...........CIPSQYQ.CNGEVDCITG......EDEVG......C
CO6_HUMAN      C.........KNKFRCDSGR............CIARKLE.CNGENDCGDN......SDERD......C
CO7_HUMAN      C.........GERFRCFSGQ............CISKSLV.CNGDSDCDEDS.....ADEDR......C
CO8A_HUMAN     C.........GQDFQCKETGR...........CLKRHLV.CNGDQDCLDG......SDEDD......C
CO8B_HUMAN     C.........EGFVCAQTGR............CVNRRLL.CNGDNDCGDQ......SDEAN......C
CO9_HUMAN      C.........GNDFQCSTGR............CIKMRLR.CNGDNDCGDF......SDEDD......C
PERL_HUMAN     C.........TEAEFACHSYNE..........CVALEYR.CDRRPDCRDM......SDELN......C
PERL_HUMAN     C.........GPQEAACRNGH...........CIPRDYL.CDGQEDCEDG......SDELD......C
PERL_HUMAN     C.........EPNEFPCGNGH...........CALKLWR.CDGDFDCEDR......TDEAN......C
PERL_HUMAN     C.........GPTQFRCVSTNM..........CIPASFH.CDEESDCPDR......SDEFG......C
SORL_HUMAN     C.........LRNQYRCSNGN...........CINSIWW.CDFDNDCGDM......SDERN......C
SORL_HUMAN     C.........DLDTQFRCQESGT.........CIPLSYK.CDLEDDCGDN......SDESH......C
SORL_HUMAN     C.........RSDEYNCSSGM...........CIRSSWV.CDGNDCRDW......SDEAN......C
SORL_HUMAN     C.........EASNFQCRNGH...........CIPQRWA.CDGDTDCQDG......SDEDPVN....C
SORL_HUMAN     C..........NGFRCPNGT............CIPSSKH.CDGLRDCSDG......SDEQH......C
SORL_HUMAN     C.........THFMDFVCKNRQQ.........CLFHSMV.CDGIIQCRDG......SDEDAAFAG..C
SORL_HUMAN     C.........DEFGFQCQNGV...........CISLIWR.CDGMDDCGDY......SDEAN......C
SORL_HUMAN     C.........SRYFQFRCENGH..........CIPNRWK.CDRENDCGDW......SDEKD......C
SORL_HUMAN     C.........LPNYYRCSSGT...........CVMDTWV.CDGYRDCADG......SDEEA......C
SORL_HUMAN     C.........DRFEFECHQPKT..........CIPNWKR.CDGHQDCQDG......RDEAN......C
SORL_HUMAN     C.........MSREFQCEDGEA..........CIVLSER.CDGFLDCSDE......SDEKA......C
APOER2_HUM     C.........EKDQFQCRNER...........CIPSVWR.CDEDDDCLDH......SDEDD......C
APOER2_HUM     C.........ADSDFTCDNGH...........CIHERWK.CDGEEECPDG......SDESEAT....C
APOER2_HUM     C.........PAEKLSCGPTSHK.........CVPASWR.CDGEKDCEGG......ADEAG......C
APOER2_HUM     C..........APHEFQCGNRS..........CLAAVFV.CDGDDDCGDG......SDERG......C
APOER2_HUM     C.........GPREFRCGGDGGGA........CIPERWV.CDRQFDCEDR......SDEAAEL....C
APOER2_HUM     C.........ATVSQFACRSGE..........CVHLGWR.CDGDRDCKDK......SDEAD......C
APOER2_HUM     C.........RGDEFQCGDGT...........CVLAIKH.CNQEQDCPDG......SDEAG......C
LDLR_HUMAN     C.........ERNEFQCQDGK...........CISYKWV.CDGSAECQDG......SDESQET....C
LDLR_HUMAN     C.........KSGDFSCGGRVNR.........CIPQFWR.CDGQVDCDNG......SDEQG......C
LDLR_HUMAN     C.........SQDEFRCHDGK...........CISRQFV.CDSDRDCLDG......SDEAS......C
LDLR_HUMAN     C.........GPASFQCNSST...........CIPQLWA.CDNDPDCEDG......SDEWPQR....C
LDLR_HUMAN     C.........SAFEFHCLSGE...........CIHSSWR.CDGGPDCKDK......SDEEN......C
LDLR_HUMAN     C.........RPDEFQCSDGN...........CIHGSRQ.CDREYDCKDM......SDEVG......C
LDLR_HUMAN     C.........EGPNKFKCHSGE..........CITLDKV.CNMARDCRDW......SDEPIKE....C
LDVR_HUMAN     C.........EPSQFQCTNGR...........CITLLWK.CDGDEDCVDG......SDEKN......C
LDVR_HUMAN     C.........AESDFVCNNGQ...........CVPSRWK.CDGDPDCEDG......SDESPEQ....C
```

```
LDVR_HUMAN    C.........RIHEISCGAHSTQ.........CIPVSWR.CDGENDCDSG......EDEEN......C
LDVR_HUMAN    C.........SPDEFTCSSGR..........CISRNFV.CNGQDDCSDG......SDELD......C
LDVR_HUMAN    C.........GAHEFQCSTSS..........CIPISWV.CDDDADCSDQ......SDESLEQ....C
LDVR_HUMAN    C.........PASEIQCGSGE..........CIHKKWR.CDGDPDCKDG......SDEVN......C
LDVR_HUMAN    C.........RPDQFECEDGS..........CIHGSRQ.CNGIRDCVDG......SDEVN......C
LDVR_HUMAN    C.........LGPGKFKCRSGE.........CIDISKV.CNQEQDCRDW......SDEPLKE....C
LRP1_HUMAN    C.........SPKQFACRDQIT.........CISKGWR.CDGERDCPDG......SDEAPEI....C
LRP1_HUMAN    C.........QPNEHNCLGTEL.........CVPMSRL.CNGVQDCNDG......SDEGPH.....C
LRP1_HUMAN    C.........QPGEFACANSR..........CIQERWK.CDGDNDCLDN......SDEAPAL....C
LRP1_HUMAN    C.........PSDRFKCENNR..........CIPNRWL.CDGDNDCGNS......EDESNAT....C
LRP1_HUMAN    C.........PPNQFSCASGR..........CIPISWT.CDLDDDCGDR......SDESAS.....C
LRP1_HUMAN    C.........FPLTQFTCNNGR.........CININWR.CDNDNDCGDN......SDEAG......C
LRP1_HUMAN    C.........SSTQFKCNSGR..........CIPEHWT.CDGDNDCGDY......SDETHAN....C
LRP1_HUMAN    C.........HTDEFQCRLDGL.........CIPLRWR.CDGDTDCMDS......SDEKS......C
LRP1_HUMAN    C.........DPSVKFGCKDSAR........CISKAWV.CDGDNDCEDN......SDEEN......C
LRP1_HUMAN    C.........RPPSHPCANNTSV........CLPPDKL.CDGNDDCGDG......SDEGEL.....C
LRP1_HUMAN    C.........RAQDEFECANGE.........CINFSLT.CDGVPHCKDR......SDEKPSY....C
LRP1_HUMAN    C.........KKTFRQCSNGR..........CVSNMLW.CNGADDCGDG......SDEIP......C
LRP1_HUMAN    C.........GVGEFRCRDGT..........CIGNSSR.CNQFVDCEDA......SDEMN......C
LRP1_HUMAN    CSSYFRLGVKGVLFQPCERTSL.........CYAPSWV.CDGANDCGDY......SDERD......C
LRP1_HUMAN    C.........PLNYFACPSGR..........CIPMSWT.CDKEDDCEHG......EDETH......C
LRP1_HUMAN    C.........SEAQFECQNHR..........CISKQWL.CDGSDDCGDG......SDEAAH.....C
LRP1_HUMAN    C.........GPSSFSCPGTHV.........CVPERWL.CDGDKDCADG......ADESIAAG...C
LRP1_HUMAN    C.........DDREFMCQNRQ..........CIPKHFV.CDHDRDCADG......SDESPE.....C
LRP1_HUMAN    C.........GPSEFRCANGR..........CLSSRQWECDGENDCHDQ......SDEAPKNPH..C
LRP1_HUMAN    C.........NASSQFLCSSGR.........CVAEALL.CNGQDDCGDS......SDERG......C
LRP1_HUMAN    C.........TASQFVCKNDK..........CIPFWWK.CDTEDDCGDH......SDEPPD.....C
LRP1_HUMAN    C.........RPGQFQCSTGI..........CTNPAFI.CDGDNDCQDN......SDEAN......C
LRP1_HUMAN    C.........LPSQFKCTNTNR.........CIPGIFR.CNGQDNCGDG......EDERD......C
LRP1_HUMAN    C.........APNQFQCSITKR.........CIPRVWV.CDRDNDCVDG......SDEPAN.....C
LRP1_HUMAN    C.........GVDEFRCKDSGR.........CIPARWK.CDGEDDCGDG......SDEPKEE....C
LRP1_HUMAN    C.........EPYQFRCKNNR..........CVPGRWQ.CDYDNDCGDN......SDEES......C
LRP1_HUMAN    C.........SESEFSCANGR..........CIAGRWK.CDGDHDCADG......SDERD......C
LRP1_HUMAN    C.........DMDQFQCKSGH..........CIPLRWR.CDADADCMDG......SDEEA......C
LRP1_HUMAN    C.........PLDEFQCNNTL..........CKPLAWK.CDGEDDCGDN......SDENPEE....C
LRP1_HUMAN    C.........PPNRPFRCKNDRV........CLWIGRQ.CDGTDNCGDG......TDEED......C
LRP1_HUMAN    C.........KDKKEFLCRNQR.........CLSSSLR.CNMFDDCGDG......SDEED......C
LRP2_HUMAN    C.........DSAHFRCGSGH..........CIPADWR.CDGTKDCSDD......ADEIG......C
LRP2_HUMAN    C.........QQGYFKCQSEGQ.........CIPSSWV.CDQDQDCDDG......SDERQD.....C
LRP2_HUMAN    C.........SSHQITCSNGQ..........CIPSEYR.CDHVRDCPDG......ADEND......C
LRP2_HUMAN    C...........EQLTCDNGA..........CYNTSQK.CDWKVDCRDS......SDEIN......C
LRP2_HUMAN    C.........LHNEFSCGNGE..........CIPRAYV.CDHDNDCQDG......SDEHA......C
LRP2_HUMAN    C.........GGYQFTCPSGR..........CIYQNWV.CDGEDDCKDN......GDEDG......C
LRP2_HUMAN    C.........SPREWSCPESGR.........CISIYKV.CDGILDCPGR......EDENNTSTGKYC
LRP2_HUMAN    C.........GLFSFPCKNGR..........CVPNYYL.CDGVDDCHDN......SDEQL......C
LRP2_HUMAN    C.........SSSAFTCGHGE..........CIPAHWR.CDKRNDCVDG......SDEHN......C
LRP2_HUMAN    C.........LDTQYTCDNHQ..........CISKNWV.CDTDNDCGDG......SDEKN......C
LRP2_HUMAN    C.........QPSQFNCPNHR..........CIDLSFV.CDGDKDCVDG......SDEVG......C
LRP2_HUMAN    C.........TASQFKCASGDK.........CIGVTNR.CDGVFDCSDN......SDEAG......C
LRP2_HUMAN    C.........HSDEFQCQEDGI.........CIPNFWE.CDGHPDCLYG......SDEHNA.....C
LRP2_HUMAN    C.........PSSYFHCDNGN..........CIHRAWL.CDRDNDCGDM......SDEKD......C
LRP2_HUMAN    C.........PSWQWQCLGHNI.........CVNLSVV.CDGIFDCPNG......TDESPL.....C
LRP2_HUMAN    C.........GASSFTCSNGR..........CISEEWR.CDNDNDCGDG......SDEMESV....C
LRP2_HUMAN    C.........SPTAFTCANGR..........CVQYSYR.CDYYNDCGDG......SDEAG......C
LRP2_HUMAN    C.........NATTEFMCNNRR.........CIPREFI.CNGVDNCHDNNT....SDEKN......C
LRP2_HUMAN    C.........QSGYTKCHNSNI.........CIPRVYL.CDGDNDCGDN......SDENPTY....C
LRP2_HUMAN    C.........SSSEFQCASGR..........CIPQHWY.CDQETDCFDA......SDEPAS.....C
LRP2_HUMAN    C.........LADEFKCDGGR..........CIPSEWI.CDGDNDCGDM......SDEDKRHQ...C
LRP2_HUMAN    C.........SDSEFLCVNDRPPDRR.....CIPQSWV.CDGDVDCTDG......YDENQN.....C
LRP2_HUMAN    C.........SENEFTCGYGL..........CIPKIFR.CDRHNDCGDY......SDERG......C
LRP2_HUMAN    C.........QQNQFTCQNGR..........CISKTFV.CDEDNDCGDG......SDELMHL....C
LRP2_HUMAN    C.........PPHEFKCDNGR..........CIEMMKL.CNHLDDCLDN......SDERG......C
LRP2_HUMAN    C.........SSTQFLCANNEK.........CIPIWWK.CDGQKDCSDG......SDELAL.....C
LRP2_HUMAN    C.........RLGQFQCSDGN..........CTSPQTL.CNAHQNCPDG......SDEDRLL....C
LRP2_HUMAN    C.........DSNEWQCANKR..........CIPESWQ.CDTFNDCEDN......SDEDSSH....C
LRP2_HUMAN    C.........RPGQFRCANGR..........CIPQAWK.CDVDNDCGDH......SDEPIEE....C
LRP2_HUMAN    C.........DNFTEFSCKTNYR........CIPKWAV.CNGVDDCRDN......SDEQG......C
LRP2_HUMAN    C.........HPVGDFRCKNHH.........CIPLRWQ.CDGQNDCGDN......SDEEN......C
LRP2_HUMAN    C.........TESEFRCVNQQ..........CIPSRWI.CDHYNDCGDN......SDERD......C
LRP2_HUMAN    C.........HPEYFQCTSGR..........CVHSELK.CDGSADCLDA......SDEAD......C
LRP2_HUMAN    C.........QATMFECKNHV..........CIPPYWK.CDGDDDCGDS......SDEELHL....C
LRP2_HUMAN    C.........NSPNRFRCDNNR.........CIYSHEV.CNGVDDCGDS......TDETEEH....C
LRP2_HUMAN    C.........TEYEYKCGNGH..........CIPHDNV.CDDADDCGDW......SDELG......C
LR1B_HUMAN    C.........DPGEFLCHDHVT.........CVSQSWL.CDGDPDCPDD......SDESLDT....C
LR1B_HUMAN    C.........PLNHIACLGTNK.........CVHLSQL.CNGVLDCPDG......YDEGVH.....C
LR1B_HUMAN    C.........KAGEFRCKNRH..........CIQARWK.CDGDDDCLDG......SDEDSVN....C
```

```
LR1B_HUMAN         C.........PDDQFKCQNNR...........CIPKRWL.CDGANDCGSN......EDESNQT....C
LR1B_HUMAN         C.........QVDQFSCGNGR...........CIPRAWL.CDREDDCGDQ......TDEMAS.....C
LR1B_HUMAN         C.........EPLTQFVCKSGR..........CISSKWH.CDSDDDCGDG......SDEVG......C
LR1B_HUMAN         C.........FDNQFRCSSGR...........CIPGHWA.CDGDNDCGDF......SDEAQIN....C
LR1B_HUMAN         C.........NGNEFQCHPDGN..........CVPDLWR.CDGEKDCEDG......SDEKG......C
LR1B_HUMAN         C.........DHKTKFSCWSTGR.........CINKAWV.CDGDIDCEDQ......SDEDD......C
LR1B_HUMAN         C.........GPPKHPCANDTSV.........CLQPEKL.CNGKKDCPDG......SDEGYL.....C
LR1B_HUMAN         C.........NAYSEFECGNGE..........CIDYQLT.CDGIPHCKDK......SDEKLLY....C
LR1B_HUMAN         C.........RRGFKPCYNRR...........CIPHGKL.CDGENDCGDN......SDELD......C
LR1B_HUMAN         C.........ATVEFRCADGT...........CIPRSAR.CNQNIDCADA......SDEKN......C
LR1B_HUMAN         CTHFYKLGVKTTGFIRCNSTSL..........CVLPTWI.CDGSNDCGDY......SDELK......C
LR1B_HUMAN         C.........EENYFSCPSGR...........CILNTWI.CDGQKDCEDG......RDEFH......C
LR1B_HUMAN         C.........SWNQFACSAQK...........CISKHWI.CDGEDDCGDG......LDESDSI....C
LR1B_HUMAN         C.........AADMFSCQGSRA..........CVPRHWL.CDGERDCPDG......SDELSTAG...C
LR1B_HUMAN         C.........DENAFMCHNKV...........CIPKQFV.CDHDDDCGDG......SDESPQ.....C
LR1B_HUMAN         C.........GTEEFSCADGR...........CLLNTQWQCDGDFDCPDH......SDEAPLNPK..C
LR1B_HUMAN         C.........NSSFFMCKNGR...........CIPSGGL.CDNKDDCGDN......SDERN......C
LR1B_HUMAN         C.........TASQFRCKTDK...........CIPFWWK.CDTVDDCGDG......SDEPDD.....C
LR1B_HUMAN         C.........QPGRFQCGTGL...........CALPAFI.CDGENDCGDN......SDELN......C
LR1B_HUMAN         C.........LSGQFKCTKNQK..........CIPVNLR.CNGQDDCGDE......EDERD......C
LR1B_HUMAN         C.........SPDYFQCKTTKH..........CISKLWV.CDEDPDCADA......SDEAN......C
LR1B_HUMAN         C.........GPHEFQCKNNN...........CIPDHWR.CDSQNDCSDN......SDEEN......C
LR1B_HUMAN         C.........TLKDFLCANGD...........CVSSRFW.CDGDFDCADG......SDERN......C
LR1B_HUMAN         C.........SKDQFRCSNGQ...........CIPAKWK.CDGHEDCKYG......EDEKS......C
LR1B_HUMAN         C.........SSREYICASDG...........CISASLK.CNGEYDCADG......SDEMD......C
LR1B_HUMAN         C.........KEDQFRCKNKAH..........CIPIRWL.CDGIHDCVDG......SDEEN......C
LR1B_HUMAN         C.........RADEFLCNNSL...........CKLHFWV.CDGEDDCGDN......SDEAPDM....C
LR1B_HUMAN         C.........PSTRPHRCRNNRI.........CLQSEQM.CNGIDECGDN......SDEDH......C
LR1B_HUMAN         C.........KKDEFACSNKK...........CIPMDLQ.CDRLDDCGDG......SDEQG......C

O75851             C.........AEGEALCQENGH..........CVPHGWL.CDNQDDCGDG......SDEEGE.....C
O75851             C.........GEGQMTCSSGH...........CLPLALL.CDRQDDCGDG......TDEPSYP....C
O75851             C.........PQGLLACADGR...........CLPPALL.CDGHPDCLDA......ADEES......C
O75851             C.........VPGEVSCVDGT...........CLGAIQL.CDGVWDCPDG......ADEGPGH....C
ENSP00000262089
- O75851          C.........GPFEFRCGSGE...........CTPRGWR.CDQEEDCADG......SDERG......C
ENSP00000262089
                   C.........APHHAPCARGPH..........CVSPEQL.CDGVRQCPDG......SDEGPDA....C
O75851             C.........PGLFPCGVAPGL..........CLTPEQL.CDGIPDCPQG......EDELD......C
O75851             C.........PEYTCPNGT.............CIGFQLV.CDGQPDCGRPGQVGPSPEEQG......C
O75851             C.........EPGVGLRCASGE..........CVLRGGP.CDGVLDCEDG......SDEEG......C
ENSP00000262089
                   C.........GPGQTPCEVLG...........CVEQAQV.CDGREDCLDG......SDERH......C
O75851             C.........SPSQLSCGSGE...........CLSAERR.CDLRPDCQDG......SDEDG......C
C18oRF1            C...........KFTCTSGK............CLYLGSLVCNQQNDCGDN......SDEEN......C
AAH07083/Q9NPF0
                   C.........PPTKFQCRTSGL..........CVPLTWR.CDRDLDCSDG......SDEEE......C
AAH07083/Q9NPF0
                   C.........LAGELRCTLSDD..........CIPLTWR.CDGHPDCPDS......SDELG......C
Q9HBX9             C.........SLGYFPCGNITK..........CLPQLLH.CNGVDDCGNQ......ADEDN......C
Q9BY79/Q96DQ9     C.........AHDEFRCDQLI...........CLLPDSV.CDGFANCADG......SDETN......C
Q9BY79/Q96DQ9     C.........GPSELSCQAGG...........CKGVQWM.CDMWRDCTDG......SDDN.......C
BAB55257 =
ENSP00000239367
                   C.........SRYHFFCDDGC...........CIDITLA.CDGVQQCPDG......SDEDF......C
O95518 =          C.........PGEFLCSVNGL...........CVPA....CDGVKDCPNG......LDERN......C
ENSP00000255793
ENSP00000255793
                   C.........RATFQCKEDST...........CISLPKV.CDGQPDCLNG......SDEEQ......C
ENSP00000255793
                   C.........GTFTFQCEDRS...........CVKKPNPQCDGRPDCRDG......SDEEH......C

Q8WXD0      C        QKGYFPCGNLTK         CLPRAFH  CDGKDDCGNG       ADEEN      C
Q8NBJ0      C        STARYHCKNGL          CIDKSFI  CDGQNNCQDN       SDEES      C
Q8NBJ0      C        GPTFFPCASGIH         CIIGRFR  CNGFEDCPDG       SDEEN      C
Q8NBJ0      C        NIPGNFMCSNGR         CIPGAWQ  CDGLPDCFDK       SDEKE      C
MEGF7       C        ALDQFLCWNGR          CIGQRKL  CNGVNDCGDN       SDESPQQN   C
MEGF7       C        EEDEFPCQNGY          CIRSLWH  CDGDNDCGDN       SDEQ       C
MEGF7       C        RSGEFMCDSGL          CINAGWR  CDGDADCDDQ       SDERN      C
MEGF7       C        TAEQFRCHSGR          CVRLSWR  CDGEDDCADN       SDEEN      C
MEGF7       C        SPLDFHCDNGK          CIRRSWV  CDGDNDCEDD       SDEQD      C
MEGF7       C        NLEEFQCAYGR          CILDIYH  CDGDDDCGDW       SDESD      C
MEGF7       C        SDKEFRCSDGS          CIAEHWY  CDGDTDCKDG       SDEEN      C
MEGF7       C        GRSHFTCAVSALGECT     CIPAQWQ  CDGDNDCGDH       SDEDG      C
CAD61944    C        LQEEFQCLNHR          CVSAVQR  CDGVDACGDG       SDEAG      C
```

| | | | | | |
|---|---|---|---|---|---|
| CAD61944 | C | PPGHFPCGAAGTSGATA | CYLPADR CNYQTFCADG | ADERR | C |
| CAD61944 | C | QPGNFRCRDEK | CVYETWV CDGQPDCADG | SDEWD | C |
| ENSG00000181006 | C | PEITDFLCRDKK | CIASHLL CDYKPDCSDR | SDEAH | C |
| ENSP00000320248 | C | NNRTFKCGNDI | CFRKQNAKCDGTVDCPDG | SDEEG | C |
| ENSP00000277547 | C | PPGHHHCQNKV | CVEPQQL CDGEDNCGDL | SDENPLT | C |
| ENSP00000320022 | C | KQGHLACGDL | CVPPEQL CDFEEQCAGG | EDEQA | C |
| ENSP00000313222 | C | PGNSFSCGNSQ | CVTKVNPECDDQEDCSDG | SDEAH | C |

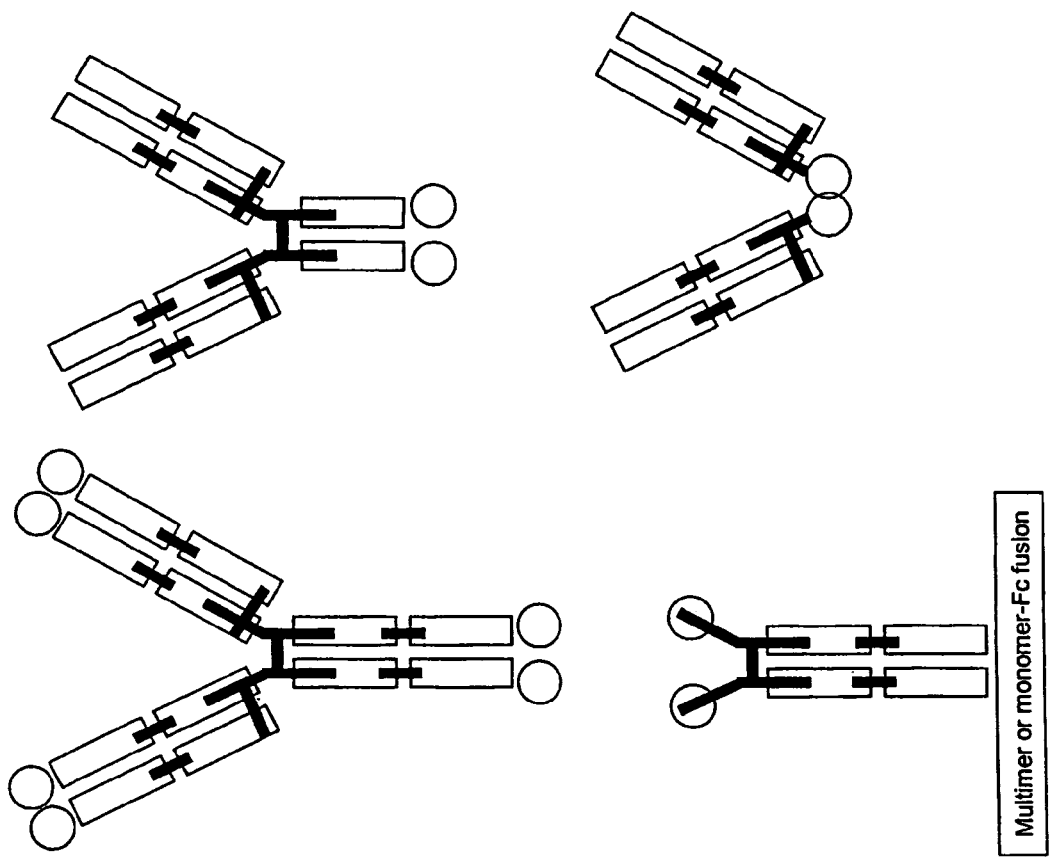
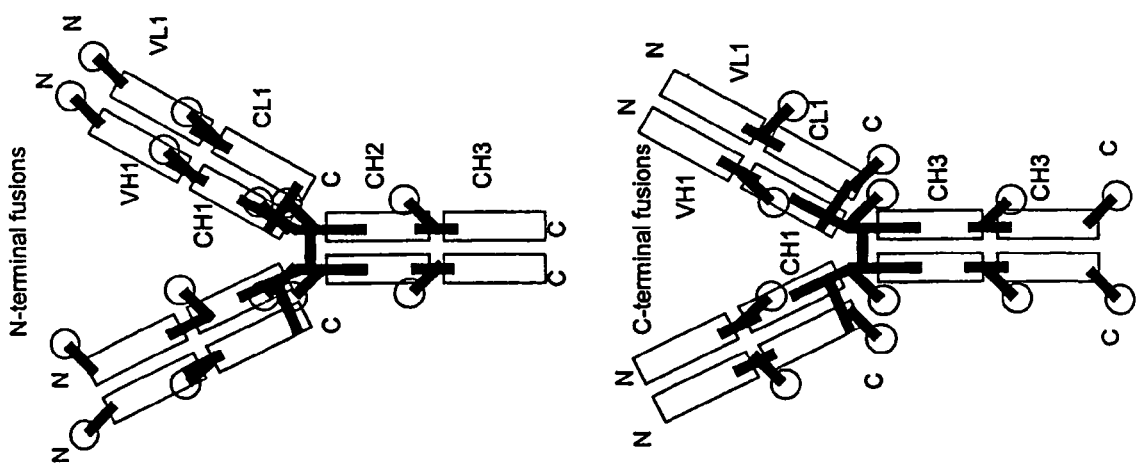
Figure 7

Inhibition of IL-6-induced IgE expression

Inhibition of IgG Production

Inhibition of SAA Production

IL-6 BINDING PROTEINS

CROSS-REFERENCE TO RELATED PATENT APPLICATIONS

This application is a continuation-in-part of U.S. patent application Ser. No. 11/486,246, filed Jul. 12, 2006, and claims the benefit of priority of U.S. Provisional Application. No. 60/699,137, filed Jul. 13, 2005. Both of those applications are incorporated by reference for all purposes.

SEQUENCE LISTING

The instant application contains a "lengthy" Sequence Listing which has been submitted via CD-R in lieu of a printed paper copy, and is hereby incorporated by reference in its entirety. Said CD-Rs, recorded on Aug. 23, 2007, are labeled CRF, "Copy 1" and "Copy 2", respectively, and each contains only one identical 888 KB file (10398004.APP).

BACKGROUND OF THE INVENTION

Interleukin-6 (IL-6) has a central role in regulating the immune response and inflammation. IL-6 has a range of biological activities, acting in an endocrine, autocrine, and paracrine fashion on a diverse number of target cells. The major sources of IL-6 are monocytes. In addition, fibroblasts and endothelial cells along with T cells and B cells, keratinocytes, mesangial cells, and several tumor cells produce IL-6. Its synthesis is induced by IL-1, IL-2, TNF-β and interferons. IL-6 is inhibited by IL-4, IL-10, and IL-13. IL-6 thus plays an important role in immune regulation and inflammation as well as autoimmune diseases.

IL-6 has the ability to stimulate the final stages of B lymphocyte maturation, whereby B lymphocytes differentiate into mature plasma cells and secrete immunoglobulins (Ig). In addition, IL-6 induces IgE production and enhances T cell growth and cytotoxic T cell differentiation through augmentation of IL-2 receptor expression and IL-2 production. IL-6 also induces the secretion of hepcidin and promotes the production of vascular endothelial growth factor (VEGF). IL-6 is a growth factor for both tumor cells, including multiple myeloma and renal carcinoma cells, and non-tumor cells, including mesangial cells.

IL-6 synergizes with other cytokines to support bone marrow stem cell maturation, is a neutrophil activator and stimulates the production of platelets from megakaryocytes. It is also a potent inducer of terminal macrophage and osteoclast differentiation. IL-6 also shares several activities with IL-1 and TNF, including the induction of pyrexia and the production of acute phase proteins such as serum amyloid A, C reactive protein (CRP), alpha 1 antitrypsin, fibrinogen, and haptoglobulin. IL-6 and IL-3 synergize to support the formation of multilineage blast-cell colonies.

IL-6 mediates several unique anti-inflammatory effects. Where both IL-1 and TNF-α induce synthesis of each other, as well as IL-6, IL-6 terminates this upregulatory inflammatory cascade and inhibits IL-1 and TNF-α synthesis. IL-6 is also important as a cell growth factor that can induce proliferation of epidermal keratinocytes and mesangial cells and has an active role in mesangial proliferative glomerulonephritis.

The receptor complex for IL-6 ("IL-6 Receptor Complex") belongs to the type I cytokine receptor superfamily and consists of two chains, IL-6R (80 kDa glycoprotein) and gp130. IL-6R is the ligand specific binding component while gp130 is a shared receptor component responsible for transmitting intracellular signals of IL-6 related cytokines such as leukemia inhibitory factor (LIF), ciliary neurotropic factor, oncostatin M, and IL-11.

The binding of IL-6 to its receptor leads to dimerization of gp130, resulting in the activation of gp130 associated kinase JAK1 and subsequently the tyrosine phosphorylation of gp130. Phosphorylation of gp130 mediates recruitment of STAT3 proteins, leading to enhanced transcription of many genes, including those that encode acute phase proteins. Whereas gp130 is ubiquitously expressed, IL-6R is more restricted. For example, IL-6R is expressed on immunocompetent cells and hepatocytes. Both IL-6R and gp130 have soluble forms. The complex of IL-6 and soluble IL-6R can act on cells expressing only gp130. This is potentially an important proinflammatory mechanism for soluble receptors.

BRIEF SUMMARY OF THE INVENTION

The present invention provides a polypeptide comprising a monomer domain that binds to (e.g., selectively binds) IL-6. In some embodiments, the polypeptide comprises a monomer domain that binds to IL-6, wherein the monomer domain is an LDL receptor class A monomer domain comprising either of the following sequences:

```
                                          (SEQ ID NO: 2)
CXXXQFQCXSG[W, Y]C[I, L, F]XXXW[V, L]CDGXNDCEDXSDE

XXC
or
                                          (SEQ ID NO: 3)
CX[A, P]X[E, Q]FXCXXGQC[I, L]PXXXXCDGX[D, N]DCXDXS

DEXXC,
``` wherein X is any amino acid and amino acids in brackets indicate alternative amino acids at a specified position.

In some embodiments, the polypeptide comprises

```
                                          (SEQ ID NO: 2)
CXXXQFQCXSG[W, Y]C[I, L, F]XXXW[V, L]CDGXNDCEDXSDE

XXC.
```

In some embodiments, the polypeptide comprises

```
                                          (SEQ ID NO: 3)
CX[A, P]X[E, Q]FXCXXGQC[I, L]PXXXXCDGX[D, N]DCXDXS

DEXXC.
```

In some embodiments, the polypeptide comprises at least one and no more than six monomer domains that bind IL-6.

In some embodiments, the polypeptide comprises at least two monomer domains that bind IL-6. In some embodiments, the polypeptide comprises a first monomer domain with binding specificity for IL-6 and a second monomer domain with binding specificity for IL-6; wherein:

the first monomer domain comprises

```
                                          (SEQ ID NO: 2)
CXXXQFQCXSG[W, Y]C[I, L, F]XXXW[V, L]CDGXNDCEDXSDE

XXC;
``` and
the second monomer domain comprises

CX[A, P]X[E, Q]FXCXXGQC[I, L]PXXXXCDGX[D, N]DCXDXS (SEQ ID NO: 3)
DEXXC.

In some embodiments, the polypeptide comprises:

CX[A, P]X[E, Q]FXCXXGQC[I, L]PXXXXCDGX[D, N]DCXDXS (SEQ ID NO: 4)
DEXXCX$_n$CXXXQFQCXSG[W, Y]C[I, L, F]XXXW[V, L]CDGXND
CEDXSDEXXC, wherein n is between 0 and 100. In some embodiments, n is 3-15, 1-20, 0-30, or 0-50.

In some embodiments, the polypeptide comprises any one or more of the following sequences (SEQ ID NOS:5-13):

CHPTGQFRCRSSGRCVSPTWVCDGDNDCGDNSDEENCSAPASEPPGSLCL
PDQFRCGNGQCIPLDWVCDGVNDCPDDSDEEGCPPRTCAPSQFQCGSGYC
ISQRWVCDGENDCEDGSDEANCAGSVPTCPSDEFRCRNGRCIPRAWRCDG
VNDCADNSDEEDCTEHT;
CHPTGQFRCRSSGRCVSPTWVCDGDNDCGDNSDEENCSAPASEPPGSLCL
PDQFRCGNGQCIPLDWVCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;
CHPTGQFRCRSSGRCVSPTWVCDGDNDCGDNSDEENCSAPASEPPGSLCR
ADEFQCGSGRCVPADWLCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;
CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEEDCTQHT;
CHPTGQFRCRSSGRCVSPTWVCDGDNDCGDNSDEENCSAPASEPPGSLCQ
ANEFTCSSGNCLSPALLCDGVDDCGDNSDETYCASPAPTCLPSQFQCGSG
YCISQRWVCDGENDCEDSSDEANCAGSVPTCQPGEFTCESGRCLPLRWLC
DGEDDCVDSSDEASCQPPT;
CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEADCAAPT;
CHPTGQFRCRSSGRCVSPTWVCDGDNDCGDNSDEENCSAPASEPPGSLCL
PDQFRCGNGQCIPLDWVCDGVNDCEDDSDEESCPPHTCLPDQFQCGSGYC
LSQRWVCDGENDCEDGSDEANCAGSVPTCPSDEFRCRNGRCIPRAWRCDG
VNDCADNSDEEDCTEHT;
CHPTGQFRCRSSGRCVSPTWVCDGDNDCGDNSDEENCSAPASEPPGSLCE
SDQFQCDSGHCVPLNWVCDGVNDCVDGSDEAGCPPRTCLPGQFQCGSGYC
ISQRWVCDGENDCEDGSDEANCAGSVPTCPSDEFRCRNGRCIPRAWRCDG
VNDCADNSDEEDCTEHT;
or
CHPTGQFRCRSSGRCVSPTWVCDGDNDCGDNSDEENCSAPASEPPGSLCG
ASQFQCGSGYCISQRWVCDGENDCEDSSDEANCAGSVPTCLPSEFQCRDS
KICLSADWLCDGVNDCADNSDEEGCPPPTCLPDQFQCGSGYCLPQAWVCD
GENDCEDGSDETNCPART.

In some embodiments, the polypeptide comprises any one or more of the following sequences (SEQ ID NOS:14-22):

CLPDQFRCGNGQCIPLDWVCDGVNDCPDDSDEEGCPPRTCAPSQFQCGSG
YCISQRWVCDGENDCEDGSDEANCAGSVPTCPSDEFRCRNGRCIPRAWRC
DGVNDCADNSDEEDCTEHT;
CLPDQFRCGNGQCIPLDWVCDGVNDCADNSDETGCPTRTCLPSQFQCGSG
YCISQRWVCDGENDCEDGSDEANCAGSVPTCPSDEFRCRNGRCIPRAWRC
DGVNDCADNSDEEDCTEHT;
CRADEFQCGSGRCVPADWLCDGVNDCADNSDETGCPTRTCLPSQFQCGSG
YCISQRWVCDGENDCEDGSDEANCAGSVPTCPSDEFRCRNGRCIPRAWRC
DGVNDCADNSDEEDCTEHT;
CLPDQFRCGNGQCIPLDWVCDGVNDCEDDSDEESCPPRTCLPDQFQCGSG
YCLPQRWVCDGENDCEDGSDEANCAGSVPTCPSDEFRCRNGRCIPRAWRC
DGVNDCADNSDEEDCTQHT;
CQANEFTCSSGNCLSPALLCDGVDDCGDNSDETYCASPAPTCLPSQFQCG
SGYCISQRWVCDGENDCEDSSDEANCAGSVPTCQPGEFTCESGRCLPLRW
LCDGEDDCVDSSDEASCQPPT;
CLPDQFRCGNGQCIPLDWVCDGVNDCEDDSDEESCPPRTCLPDQFQCGSG
YCLPQRWVCDGENDCEDGSDEANCAGSVPTCPSDEFRCRNGRCIPRAWRC
DGVNDCADNSDEADCAAPT;
CLPDQFRCGNGQCIPLDWVCDGVNDCEDDSDEESCPPHTCLPDQFQCGSG
YCLSQRWVCDGENDCEDGSDEANCAGSVPTCPSDEFRCRNGRCIPRAWRC
DGVNDCADNSDEEDCTEHT;
CESDQFQCDSGHCVPLNWVCDGVNDCVDGSDEAGCPPRTCLPGQFQCGSG
YCISQRWVCDGENDCEDGSDEANCAGSVPTCPSDEFRCRNGRCIPRAWRC
DGVNDCADNSDEEDCTEHT;
or
CGASQFQCGSGYCISQRWVCDGENDCEDSSDEANCAGSVPTCLPSEFQCR
DSKICLSADWLCDGVNDCADNSDEEGCPPPTCLPDQFQCGSGYCLPQAWV
CDGENDCEDGSDETNCPART.

In some embodiments, the polypeptide comprises one of the IL-6-binding monomer, dimer or trimer sequences displayed herein.

In some embodiments, the polypeptide comprises three monomer domains that bind IL-6.

In some embodiments, the monomer domain is between 30 to 50 or between 35 to 45 amino acids. In some embodiments, the monomer comprises an amino acid sequence in which at least 10% of the amino acids in the sequence are cysteine and/or at least 25% of the amino acids are non-naturally occurring amino acids.

In some embodiments, the polypeptide further comprises a monomer domain that has a binding specificity for a blood factor, thereby increasing the serum half-life of the polypeptide when the polypeptide is injected into an animal compared to the serum half-life of a polypeptide lacking the blood factor-binding monomer domain. In some embodiments, the blood factor is serum albumin, an immunoglobulin or an erythrocyte.

In some embodiments, the monomer domain that has a binding specificity for a blood factor binds to immunoglobulin (IgG) and the monomer domain that has a binding specificity for a blood factor is an LDL receptor class A monomer domain comprising a sequence selected from the following:

```
CXSSGRCIPXXWVCDGXXDCRDXSDE,     (SEQ ID NO: 23)
and

CXSSGRCIPXXWLCDGXXDCRDXSDE,     (SEQ ID NO: 24)
``` wherein X is any amino acid.

In some embodiments, the monomer domain that has a binding specificity for a blood factor binds to immunoglobulin (IgG) and the monomer domain that has a binding specificity for a blood factor is an LDL receptor class A monomer domain comprising the following sequence:

```
                                (SEQ ID NO: 25)
[EQ]FXCRX[ST]XRC[IV]XXXW[ILV]CDGXXDCXD[DN]SDE,
``` wherein X is any amino acid and amino acids in brackets are alternative amino acids at a single position.

In some embodiments, the monomer domain that has a binding specificity for a blood factor includes

```
                                (SEQ ID NO: 26)
CHPTGQFRCRSSGRCVSPTWVCDGDNDCGDNSDEENC;

(SEQ ID NO: 930)
CHPTGQFRCRSSGRCVSPTWVCDGDNDCGDNSDEENCSAPASEPPGSL;

(SEQ ID NO: 931)
CLSSEFQCQSSGRCIPLAWVCDGDNDCRDDSDEKSCKPRT;
and (SEQ ID NO: 932)
CHPTGQFRCRSSGRCVSPTWVCDGDNDCGDNSDEENCKPRT.
```

In other embodiments, the half-life domain extender may be a dimer, or trimer, or other multimer, a homo- or hetero-. In some embodiments, a dimer that has a binding specificity comprises

```
                                (SEQ. ID. NO.: 933)
CHPTGQFRCRSSGRCVSPTWVCDGDNDCGDNSDEENCSAPASEPPGSLC

HPTGQFRCRSSGRCVSPTWVCDGDNDCGDNSDEENCSAPASEPPGSL.
```

In some embodiments, the polypeptide is a tetramer comprising an IL-6 binding trimer and a half-life extending monomer. Exemplary IL-6/IgG binding tetramers include (SEQ ID NOS:5-13):

```
CHPTGQFRCRSSGRCVSPTWVCDGDNDCGDNSDEENCSAPASEPPGSLCL
PDQFRCGNGQCIPLDWVCDGVNDCPDDSDEEGCPPRTCAPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCL
PDQFRCGNGQCIPLDWVCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCR
ADEFQCGSGRCVPADWLCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEEDCTQHT;

CHPTGQFRCRSSGRCVSPTWVCDGDNDCGDNSDEENCSAPASEPPGSLCQ
ANEFTCSSGNCLSPALLCDGVDDCGDNSDETYCASPAPTCLPSQFQCGSG
YCISQRWVCDGENDCEDSSDEANCAGSVPTCQPGEFTCESGRCLPLRWLC
DGEDDCVDSSDEASCQPPT;

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEADCAAPT;

CHPTGQFRCRSSGRCVSPTWVCDGDNDCGDNSDEENCSAPASEPPGSLCL
PDQFRCGNGQCIPLDWVCDGVNDCEDDSDEESCPPHTCLPDQFQCGSGYC
LSQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCE
SDQFQCDSGHCVPLNWVCDGVNDCVDGSDEAGCPPRTCLPGQFQCGSGYC
ISQRWVCDGENDCEDGSDEANCAGSVPTCPSDEFRCRNGRCIPRAWRCDG
VNDCADNSDEEDCTEHT;
or

CHPTGQFRCRSSGRCVSPTWVCDGDNDCGDNSDEENCSAPASEPPGSLCG
ASQFQCGSGYCISQRWVCDGENDCEDSSDEANCAGSVPTCLPSEFQCRDS
KICLSADWLCDGVNDCADNSDEEGCPPPTCLPDQFQCGSGYCLPQAWVCD
GENDCEDGSDETNCPART.
```

The present invention also provides methods for identifying a polypeptide that binds to (e.g., selectively binds) IL-6. In some embodiments, the method comprises, screening a library of polypeptides for affinity to IL-6; and selecting a polypeptide comprising at least one monomer domain that binds to IL-6, wherein the monomer domain: is a non-naturally occurring monomer domain, comprises at least one disulfide bond, and binds to an ion.

In some embodiments, the selected polypeptide comprises an LDL receptor A domain monomer domain comprising at least one of:

```
Family 1 motif (SEQ ID NO: 27):
CX [AS] [DN] EFXCXXGXC [ILV] XXAXXCDGV [DN]
DCXDNSDEXXC [AST] XX [AST]

Family 2 motif (SEQ ID NO: 28):
CXXXQFXC [DN] NGXCVPXXWXCDG [DE] [DN] DCXD [DN]
SDEXXCXXP [AST]

Family 3 motif (SEQ ID NO: 29):
CXXXQFQCXSG [W, Y] C [I, L, F] XXXW [V, L]
CDGXNDCEDXSDEXXC Family 4 motif (SEQ ID NO: 30):
CXXX [EQ] FXCXXGXC [ILV] XXXXXCDGX [DN] DCXDXSDEXX
(XX) C Family 5 motif (SEQ ID NO: 31):
CX [A, P] X [E, Q] FXCXXGQC [I, L] PXXXXCDGX
[D, N] DCXDXSDEXXC Family 6 motif (SEQ ID NO: 32):
CXXX [EQ] FXCX (X) SXXC [ILV] XX [DN] W [ILV]
CDGVNDCXDXSDEXGCXXXT Family 7 motif (SEQ ID NO: 33):
CL [AS] X [EQ] FXCXNGXCIP [KQR] XWVCDGDNDC [ILV]
DXSDE (P) XXCX [EKQ] XT.
```

In some embodiments, the method further comprises linking the monomer domain in the selected polypeptide to a second monomer domain to form a library of multimers, each multimer comprising at least two monomer domains; screening the library of multimers for the ability to bind to IL-6; and selecting a multimer that binds IL-6.

In some embodiments, the method further comprises linking the monomer domain in the selected polypeptide to a second monomer domain to form a library of multimers, each multimer comprising at least two monomer domains; screening the library of multimers for the ability to bind to a target molecule other than IL-6; and selecting a multimer that binds to the target molecule.

In some embodiments, the method further comprises a step of mutating at least one monomer domain, thereby providing a library comprising mutated monomer domains.

In some embodiments, the library of monomer domains is expressed as a phage display, ribosome display or cell surface display.

In some embodiments, the polypeptide comprises at least two monomer domains and the monomer domains are linked by a linker. In some embodiments, the linker is a peptide linker. In some embodiments, the linker is between 4 to 12 amino acids long.

In some embodiments, the monomer domain comprises an amino acid sequence in which at least 10% of the amino acids in the sequence are cysteine and/or at least 25% of the amino acids are non-naturally occurring amino acids.

The present invention also provides polynucleotides encoding a polypeptide comprising a monomer domain that binds to (e.g., selectively binds) IL-6, wherein the monomer domain:

is a non-naturally occurring monomer domain consisting of 30 to 50 amino acids;

comprises at least one disulfide bond.

In some embodiments, the polynucleotides encode a polypeptide comprising one of the following sequences:

```
Family 1 motif (SEQ ID NO: 27):
CX [AS] [DN] EFXCXXGXC [ILV] XXAXXCDGV [DN]
DCXDNSDEXXC [AST] XX [AST]

Family 2 motif (SEQ ID NO: 28):
CXXXQFXC [DN] NGXCVPXXWXCDG [DE] [DN] DCXD [DN]
SDEXXCXXP [AST]

Family 3 motif (SEQ ID NO: 29):
CXXXQFQCXSG [W, Y] C [I, L, F] XXXW [V, L]
CDGXNDCEDXSDEXXC Family 4 motif (SEQ ID NO: 30):
CXXX [EQ] FXCXXGXC [ILV] XXXXXCDGX [DN] DCXDXSDEXX
(XX) C Family 5 motif (SEQ ID NO: 31):
CX [A, P] X [E, Q] FXCXXGQC [I, L] PXXXXCDGX
[D, N] DCXDXSDEXXC Family 6 motif (SEQ ID NO: 32):
CXXX [EQ] FXCX (X) SXXC [ILV] XX [DN] W [ILV]
CDGVNDCXDXSDEXGCXXXT Family 7 motif (SEQ ID NO: 33):
CL [AS] X [EQ] FXCXNGXCIP [KQR] XWVCDGDNDC [ILV]
DXSDE (P) XXCX [EKQ] XT.
```

In some embodiments, the polynucleotides encode a polypeptide comprising one of the following sequences (SEQ ID NOS:5-13)

```
CHPTGQFRCRSSGRCVSPTWVCDGDNDCGDNSDEENCSAPASEPPGSLCL
PDQFRCGNGQCIPLDWVCDGVNDCPDDSDEEGCPPRTCAPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCL
PDQFRCGNGQCIPLDWVCDGVNDCADNSDETGCPTRTCLPSQFQCGSGYC
```

-continued

```
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCR
ADEFQCGSGRCVPADWLCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEEDCTQHT;

CHPTGQFRCRSSGRCVSPTWVCDGDNDCGDNSDEENCSAPASEPPGSLCQ
ANEFTCSSGNCLSPALLCDGVDDCGDNSDETYCASPAPTCLPSQFQCGSG
YCISQRWVCDGENDCEDSSDEANCAGSVPTCQPGEFTCESGRCLPLRWLC
DGEDDCVDSSDEASCQPPT;

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEADCAAPT;

CHPTGQFRCRSSGRCVSPTWVCDGDNDCGDNSDEENCSAPASEPPGSLCL
PDQFRCGNGQCIPLDWVCDGVNDCEDDSDEESCPPHTCLPDQFQCGSGYC
LSQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCE
SDQFQCDSGHCVPLNWVCDGVNDCVDGSDEAGCPPRTCLPGQFQCGSGYC
ISQRWVCDGENDCEDGSDEANCAGSVPTCPSDEFRCRNGRCIPRAWRCDG
VNDCADNSDEEDCTEHT;
or

CHPTGQFRCRSSGRCVSPTWVCDGDNDCGDNSDEENCSAPASEPPGSLCG
ASQFQCGSGYCISQRWVCDGENDCEDSSDEANCAGSVPTCLPSEFQCRDS
KICLSADWLCDGVNDCADNSDEEGCPPPTCLPDQFQCGSGYCLPQAWVCD
GENDCEDGSDETNCPART.
```

In some embodiments, the polynucleotides encode a polypeptide comprising one of the following sequences (SEQ ID NOS:14-22):

```
CLPDQFRCGNGQCIPLDWVCDGVNDCPDDSDEEGCPPRTCAPSQFQCGSG
YCISQRWVCDGENDCEDGSDEANCAGSVPTCPSDEFRCRNGRCIPRAWRC
DGVNDCADNSDEEDCTEHT;

CLPDQFRCGNGQCIPLDWVCDGVNDCADNSDETGCPTRTCLPSQFQCGSG
YCISQRWVCDGENDCEDGSDEANCAGSVPTCPSDEFRCRNGRCIPRAWRC
DGVNDCADNSDEEDCTEHT;

CRADEFQCGSGRCVPADWLCDGVNDCADNSDETGCPTRTCLPSQFQCGSG
YCISQRWVCDGENDCEDGSDEANCAGSVPTCPSDEFRCRNGRCIPRAWRC
DGVNDCADNSDEEDCTEHT;

CLPDQFRCGNGQCIPLDWVCDGVNDCEDDSDEESCPPRTCLPDQFQCGSG
YCLPQRWVCDGENDCEDGSDEANCAGSVPTCPSDEFRCRNGRCIPRAWRC
DGVNDCADNSDEEDCTQHT;

CQANEFTCSSGNCLSPALLCDGVDDCGDNSDETYCASPAPTCLPSQFQCG
SGYCISQRWVCDGENDCEDSSDEANCAGSVPTCQPGEFTCESGRCLPLRW
LCDGEDDCVDSSDEASCQPPT;

CLPDQFRCGNGQCIPLDWVCDGVNDCEDDSDEESCPPRTCLPDQFQCGSG
YCLPQRWVCDGENDCEDGSDEANCAGSVPTCPSDEFRCRNGRCIPRAWRC
DGVNDCADNSDEADCAAPT;

CLPDQFRCGNGQCIPLDWVCDGVNDCEDDSDEESCPPHTCLPDQFQCGSG
YCLSQRWVCDGENDCEDGSDEANCAGSVPTCPSDEFRCRNGRCIPRAWRC
DGVNDCADNSDEEDCTEHT;

CESDQFQCDSGHCVPLNWVCDGVNDCVDGSDEAGCPPRTCLPGQFQCGSG
YCISQRWVCDGENDCEDGSDEANCAGSVPTCPSDEFRCRNGRCIPRAWRC
DGVNDCADNSDEEDCTEHT;
or

CGASQFQCGSGYCISQRWVCDGENDCEDSSDEANCAGSVPTCLPSEFQCR
DSKICLSADWLCDGVNDCADNSDEEGCPPPTCLPDQFQCGSGYCLPQAWV
CDGENDCEDGSDETNCPART.
```

In some embodiments, the polynucleotide encoding a monomer domain with binding specificity for IL-6 is optimized for codon usage of a cell (e.g., a bacterial, plant or mammalian cell). For example,

ATGAAACACTCTGGTGGTTCGTGTCACCCTACCGGCCAATTTAGATGCCGCAGTAGCGGCAGAT (SEQ ID NO: 34)

GCGTTTCACCGACCTGGGTTTGCGACGGCGATAATGATTGTGGGGACAACTCGGATGAAGAAAA

CTGTAGCGCGCCAGCATCTGAACCGCCGGGTTCCCTGTGTCTGCCGGACCAGTTCCGGTGCGGC

AACGGCCAATGCATTCCACTGGACTGGGTTTGCGACGGCGTTAATGATTGTCCGGACGACTCGG

ATGAAGAAGGCTGTCCACCGCGTACGTGTGCGCCGAGCCAGTTCCAGTGCGGCAGCGGCTACTG

CATTTCACAGCGCTGGGTTTGCGACGGCGAAAATGATTGTGAGGACGGCTCGGATGAAGCAAAC

TGTGCAGGCTCCGTACCTACGTGTCCGTCGGACGAGTTCCGGTGCAGAAACGGCCGCTGCATTC

CACGGGCCTGGCGTTGCGACGGCGTAAATGATTGTGCGGACAACTCGGATGAAGAAGACTGTAC

AGAGCATACGTCATTGCAGTAG encodes the IL-6 binding trimer

MKHSGGSCHPTGQFRCRSSGRCVSPTWVCDGDNDCGDNSDEENCSAPASEPPGSLCLPDQFRCG (SEQ ID NO: 35)

NGQCIPLDWVCDGVNDCPDDSDEEGCPPRTCAPSQFQCGSGYCISQRWVCDGENDCEDGSDEAN

CAGSVPTCPSDEFRCRNGRCIPRAWRCDGVNDCADNSDEEDCTEHTSLQ*

However, (SEQ ID NO: 36)

ATGAAACACTCTGGTGGTAGCTGTCACCCTACCGGCCAATTTCGTTGCCGCAGTAGCGGCCGTT

GCGTTTCACCGACCTGGGTTTGCGACGGCGATAATGATTGTGGCGACAACAGCGATGAAGAAAA

CTGTAGCGCGCCAGCATCTGAACCGCCGGGTTCCCTGTGTCTGCCGGACCAGTTCCGTTGCGGC

AACGGCCAATGCATTCCACTGGACTGGGTTTGCGACGGCGTTAATGATTGTCCGGACGACTCGG

ATGAAGAAGGCTGTCCACCGCGTACGTGTGCGCCGAGCCAGTTCCAGTGCGGCAGCGGCTACTG

CATTAGCCAGCGCTGGGTTTGCGACGGCGAAAATGATTGTGAGGACGGCTCGGATGAAGCAAAC

TGTGCAGGCTCCGTACCTACGTGTCCGTCGGACGAGTTCCGCTGCCGTAACGGCCGCTGCATTC

CACGTGCCTGGCGCTGCGACGGCGTAAATGATTGTGCGGACAACAGCGATGAAGAAGACTGTAC

CGAGCATACGTCATTGCAGTAA is a polynucleotide that also encodes (SEQ ID NO: 35)

MKHSGGSCHPTGQFRCRSSGRCVSPTWVCDGDNDCGDNSDEENCSAPASEPPGSLCLPDQFRCG

NGQCIPLDWVCDGVNDCPDDSDEEGCPPRTCAPSQFQCGSGYCISQRWVCDGENDCEDGSDEAN

CAGSVPTCPSDEFRCRNGRCIPRAWRCDGVNDCADNSDEEDCTEHTSLQ*, but has been codon optimized for bacterial expression.

The present invention also provides methods for preventing, treating, or ameliorating a disease, disorder, or condition in a patient, comprising administering an IL-6 antagonist to the patient, wherein the IL-6 antagonist comprises a polypeptide comprising at least one LDL receptor class A monomer domain that selectively binds to IL-6 and at least one LDL receptor class A monomer domain that selectively binds to IgG.

In some embodiments, the disease, disorder, or condition is an inflammatory and/or autoimmune disease, disorder, or condition.

In still further embodiments, the method involves the administration of a multimer comprising any one or more of the following sequences (SEQ ID NOS:5-13):

```
CHPTGQFRCRSSGRCVSPTWVCDGDNDCGDNSDEENCSAPASEPPGSLCL
PDQFRCGNGQCIPLDWVCDGVNDCPDDSDEEGCPPRTCAPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCL
PDQFRCGNGQCIPLDWVCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCR
ADEFQCGSGRCVPADWLCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEEDCTQHT;

CHPTGQFRCRSSGRCVSPTWVCDGDNDCGDNSDEENCSAPASEPPGSLCQ
ANEFTCSSGNCLSPALLCDGVDDCGDNSDETYCASPAPTCLPSQFQCGSG
YCISQRWVCDGENDCEDSSDEANCAGSVPTCQPGEFTCESGRCLPLRWLC
DGEDDCVDSSDEASCQPPT;

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEADCAAPT;

CHPTGQFRCRSSGRCVSPTWVCDGDNDCGDNSDEENCSAPASEPPGSLCL
PDQFRCGNGQCIPLDWVCDGVNDCEDDSDEESCPPHTCLPDQFQCGSGYC
LSQRWVCDGENDCEDGSDEANCAGSVPTCPSDEFRCRNGRCIPRAWRCDG
VNDCADNSDEEDCTEHT;

CHPTGQFRCRSSGRCVSPTWVCDGDNDCGDNSDEENCSAPASEPPGSLCE
SDQFQCDSGHCVPLNWVCDGVNDCVDGSDEAGCPPRTCLPGQFQCGSGYC
ISQRWVCDGENDCEDGSDEANCAGSVPTCPSDEFRCRNGRCIPRAWRCDG
VNDCADNSDEEDCTEHT;
or

CHPTGQFRCRSSGRCVSPTWVCDGDNDCGDNSDEENCSAPASEPPGSLCG
ASQFQCGSGYCISQRWVCDGENDCEDSSDEANCAGSVPTCLPSEFQCRDS
KICLSADWLCDGVNDCADNSDEEGCPPPTCLPDQFQCGSGYCLPQAWVCD
GENDCEDGSDETNCPART.
```

Some embodiments involve exemplary IL-6/IgG binding tetramers including the following sequences (SEQ ID NOS:5 and 35):

```
CHPTGQFRCRSSGRCVSPTWVCDGDNDCGDNSDEENCSAPASEPPGSLCL
PDQFRCGNGQCIPLDWVCDGVNDCPDDSDEEGCPPRTCAPSQFQCGSGYC
ISQRWVCDGENDCEDGSDEANCAGSVPTCPSDEFRCRNGRCIPRAWRCDG
VNDCADNSDEEDCTEHT;
or

MKHSGGSCHPTGQFRCRSSGRCVSPTWVCDGDNDCGDNSDEENCSAPASE
PPGSLCLPDQFRCGNGQCIPLDWVCDGVNDCPDDSDEEGCPPRTCAPSQF
QCGSGYCISQRWVCDGENDCEDGSDEANCAGSVPTCPSDEFRCRNGRCIP
RAWRCDGVNDCADNSDEEDCTEHTSLQ.
```

DEFINITIONS

Unless otherwise indicated, the following definitions supplant those in the art.

As used herein, use of parentheses in a sequence motif indicates that that the positions within the parentheses may be present or absent (e.g., "([ekq])" indicates that the position is absent or either E, K, or Q may be at that position). When more than one "x" is used in parentheses (e.g., "(xx)"), each x represents a possible position. Thus "(xx)" indicates that zero, one or two amino acids may be at that position(s), where each amino acid is independently selected from any amino acid.

The terms "monomer domain" or "monomer" are used interchangeably and herein refer to a discrete region found in a protein or polypeptide. A monomer domain forms a native three-dimensional structure in solution in the absence of flanking native amino acid sequences. Monomer domains of the invention will often bind to a target molecule. For example, a polypeptide that forms a three-dimensional structure that binds to a target molecule is a monomer domain. As used herein, the term "monomer domain" does not encompass the complementarity determining region (CDR) of an antibody. Monomer domains of the present invention can be naturally occurring domains or non-naturally occurring variants.

The term "naturally occurring" is used herein to indicate that an object or sequence can be found in nature. For example, monomer domains having a naturally occurring amino acid sequence can include human monomer domains or optionally, domains derived from different species or sources, e.g., mammals, primates, rodents, fish, birds, reptiles, plants, etc. Polynucleotides (and corresponding sequences) encoding naturally occurring monomer domains may be obtained by a number of methods, e.g., by PCR amplification of genomic DNA or cDNA.

As used herein, the term "non-naturally occurring" refers to an object that is not found in nature or that has been structurally modified or synthesized by man. When referring to monomers, the non-naturally occurring monomer may have amino acid sequences not found in a naturally occurring counterpart or may have one or more non-naturally occurring amino acid sequences that are altered from naturally occurring monomer domains. Non-naturally occurring monomers may include, but are not limited to, ancestral domains, chimeric domains, randomized domains, mutated domains, and the like. Alternatively, the term "non-naturally occurring" may refer to multimers. Such non-naturally occurring multimers may include multimers containing naturally occurring monomer domains in an order or juxtaposition not found in nature or non-naturally occurring monomer domains.

A "non-naturally occurring amino acid" in a protein sequence refers to any amino acid other than the amino acid that occurs in the corresponding position in an alignment with a naturally occurring polypeptide with the lowest smallest sum probability where the comparison window is the length of the monomer domain queried and when compared to a naturally occurring sequence in the non-redundant ("nr") database of Genbank using BLAST 2.0 as described herein.

The term "loop" refers to that portion of a monomer domain that is typically exposed to the environment by the assembly of the scaffold structure of the monomer domain protein, and which is involved in target binding. The present invention provides three types of loops that are identified by specific features, such as, potential for disulfide bonding, bridging between secondary protein structures, and molecular dynamics (i.e., flexibility). The three types of loop sequences are a cysteine-defined loop sequence, a structure-defined loop sequence, and a B-factor-defined loop sequence.

As used herein, the term "cysteine-defined loop sequence" refers to a subsequence of a naturally occurring monomer domain-encoding sequence that is bound at each end by a cysteine residue that is conserved with respect to at least one other naturally occurring monomer domain of the same family. Cysteine-defined loop sequences are identified by multiple sequence alignment of the naturally occurring monomer domains, followed by sequence analysis to identify conserved cysteine residues. The sequence between each consecutive pair of conserved cysteine residues is a cysteine-defined loop sequence. The cysteine-defined loop sequence does not include the cysteine residues adjacent to each terminus. Monomer domains having cysteine-defined loop sequences include the LDL receptor A-domains, EGF-like domains, sushi domains, Fibronectin type 1 domains, and the like.

As used herein the terms "LDL receptor A-domain," "LDL receptor class A-domain" and "A-domain" are used interchangeably to refer to a consensus sequence, $CX_6CX_4CX_6CX_5CX_8C$ (SEQ ID NO:37), wherein $X_6$, $X_4$, $X_5$, and $X_8$ each represent a cysteine-defined loop sequence comprising the designated number of amino acids. Such A-Domains have also been referred to in the scientific literature as LDL receptor-like modules, LDL-A modules, complement-type repeat-domains and CR-Domains.

The term "structure-defined loop sequence" refers to a subsequence of a monomer-domain encoding sequence that is bound at each end to subsequences that each form a secondary structure. Secondary structures for proteins with known three dimensional structures are identified in accordance with the algorithm STRIDE for assigning protein secondary structure as described in Frishman, D. and Argos, P. (1995) "Knowledge-based secondary structure assignment," Proteins, 23(4):566-79 (see also //hgmp.mrc.ac.uk/Registered/Option/stride.html at the World Wide Web). Secondary structures for proteins with unknown or uncharacterized three dimensional structures are identified in accordance with the algorithm described in Jones, D. T. (1999), "Protein secondary structure prediction based on position-specific scoring matrices," J. Mol. Biol. 292:195-202 (see also McGuffin, L. J., Bryson, K., Jones, D. T. (2000) "The PSIPRED protein structure prediction server," Bioinformatics. 16:404-405, and //bioinf.cs.ucl.ac.uk/psipred/at the World Wide Web). Secondary structures include, for example, pleated sheets, helices, disulfide bonds and the like. Examples of monomer domains having structure-defined loop sequences are the C2 domains, Ig domains, Factor 5/8 C domains, Fibronectin type 3 domains, A-Domains, and the like.

The term "B-factor-defined loop sequence" refers to a subsequence of at least three amino acid residues of a monomer-domain encoding sequence in which the B-factors for the alpha carbons in the B-factor-defined loop are among the 25% highest alpha carbon B factors in the entire monomer domain. Typically the average alpha-carbon B-factor for the subsequence is at least about 65. As used herein, the term "B-factor" (or "temperature factor" or "Debye-Waller factor") is derived from X-ray scattering data. The B-factor is a factor that can be applied to the X-ray scattering term for each atom, or for groups of atoms, that describes the degree to which electron density is spread out B-factors employed in the practice of the present invention may be either isotropic or anisotropic. The term "average alpha-carbon B-factor" refers to:

$$\left(\sum_{i=1}^{n} B\text{-}factor_{C\alpha i}\right)/n$$

where n corresponds to the number of residues in the loop, and is at least 3, and B-factor$_{C\alpha i}$ is the B-factor for the alpha carbon of amino acid residue i of the loop.

The term "multimer" is used herein to indicate a polypeptide comprising at least two monomer domains. The separate monomer domains in a multimer can be joined together by a linker. A multimer is also known as a combinatorial mosaic protein or a recombinant mosaic protein. A multimer includes dimers, trimers, and tetramers, and may be homomultimer or a heteromultimer.

As used herein, the term "dimer" is used to indicate a polypeptide comprising two monomer domains. The separate monomer domains in a dimer may be joined together by a linker.

As used herein, the term "trimer" is used to indicate a polypeptide comprising three monomer domains. The separate monomer domains in a trimer may be joined together by a linker.

As used herein, the term "tetramer" is used to indicate a polypeptide comprising four monomer domains. The separate monomer domains in a tetramer may be joined together by a linker.

The term "family" and "family class" are used interchangeably to indicate proteins that are grouped together based on similarities in their amino acid sequences. These similar sequences are generally conserved because they are important for the function of the protein and/or the maintenance of the three dimensional structure of the protein. Examples of such families include the LDL Receptor A-domain family, the EGF-like family, and the like. Additionally, related sequences that bind to the same target molecule can be divided into families based on common sequence motifs.

The term "ligand," also referred to herein as a "target molecule," encompasses a wide variety of substances and molecules, which range from simple molecules to complex targets. Target molecules can be proteins, nucleic acids, lipids, carbohydrates or any other molecule capable of recognition by a polypeptide domain. For example, a target molecule can include a chemical compound (i.e., non-biological compound such as, e.g., an organic molecule, an inorganic molecule, or a molecule having both organic and inorganic atoms, but excluding polynucleotides and proteins), a mixture of chemical compounds, an array of spatially localized compounds, a biological macromolecule, a bacteriophage peptide display library, a polysome peptide display library, an extract made from a biological materials such as bacteria, plants, fungi, or animal (e.g., mammalian) cells or tissue, a protein, a toxin, a peptide hormone, a cell, a virus, or the like. Other target molecules include, e.g., a whole cell, a whole tissue, a mixture of related or unrelated proteins, a mixture of viruses or bacterial strains or the like. Target molecules can also be defined by inclusion in screening assays described herein or by enhancing or inhibiting a specific protein interaction (i.e., an agent that selectively inhibits a binding interaction between two predetermined polypeptides).

The term "linker" is used herein to indicate a moiety or group of moieties that joins or connects two or more discrete separate monomer domains. The linker allows the discrete separate monomer domains to remain separate when joined together in a multimer. The linker moiety is typically a substantially linear moiety. Suitable linkers include polypeptides, polynucleic acids, peptide nucleic acids and the like. Suitable linkers also include optionally substituted alkylene moieties that have one or more oxygen atoms incorporated in the carbon backbone. Typically, the molecular weight of the linker is less than about 2000 daltons. More typically, the molecular weight of the linker is less than about 1500 daltons and usually is less than about 1000 daltons. The linker can be small enough to allow the discrete separate monomer domains to cooperate, e.g., where each of the discrete separate monomer domains in a multimer binds to the same target molecule via separate binding sites. Exemplary linkers include a polynucleotide encoding a polypeptide, or a polypeptide of amino acids or other non-naturally occurring moieties. The linker can be a portion of a native sequence, a variant thereof, or a synthetic sequence. Linkers can comprise, e.g., naturally occurring, non-naturally occurring amino acids, or a combination of both.

The term "separate" is used herein to indicate a property of a moiety that is independent and remains independent even when complexed with other moieties, including for example, other monomer domains. A monomer domain is a separate domain in a protein because it has an independent property that can be recognized and separated from the protein. For instance, the ligand binding ability of the A-domain in the LDL receptor is an independent property. Other examples of separate include the separate monomer domains in a multimer that remain separate independent domains even when complexed or joined together in the multimer by a linker. Another example of a separate property is the separate binding sites in a multimer for a ligand.

As used herein, "directed evolution" refers- to a process by which polynucleotide variants are generated, expressed, and screened for an activity (e.g., a polypeptide with binding activity) in a recursive process. One or more candidates in the screen are selected and the process is then repeated using polynucleotides that encode the selected candidates to generate new variants. Directed evolution involves at least two rounds of variation generation and can include 3, 4, 5, 10, 20 or more rounds of variation generation and selection. Variation can be generated by any method known to those of skill in the art, including, e.g., by error-prone PCR, gene recombination, chemical mutagenesis and the like.

The term "shuffling" is used herein to indicate recombination between non-identical sequences. In some embodiments, shuffling can include crossover via homologous recombination or via non-homologous recombination, such as via cre/lox and/or flp/frt systems. Shuffling can be carried out by employing a variety of different formats, including for example, in vitro and in vivo shuffling formats, in silico shuffling formats, shuffling formats that utilize either double-stranded or single-stranded templates, primer based shuffling formats, nucleic acid fragmentation-based shuffling formats, and oligonucleotide-mediated shuffling formats, all of which are based on recombination events between non-identical sequences and are described in more detail or referenced herein below, as well as other similar recombination-based formats. The term "random" as used herein refers to a polynucleotide sequence or an amino acid sequence composed of two or more amino acids and constructed by a stochastic or random process. The random polynucleotide sequence or amino acid sequence can include framework or scaffolding motifs, which can comprise invariant sequences.

The term "pseudorandom" as used herein refers to a set of sequences, polynucleotide or polypeptide, that have limited variability, so that the degree of residue variability at some positions is limited, but any pseudorandom position is allowed at least some degree of residue variation.

The terms "polypeptide," "peptide," and "protein" are used herein interchangeably to refer to an amino acid sequence of two or more amino acids.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. "Amino acid mimetics" refers to chemical compounds that have a structure that is different from the general chemical structure of an amino acid, but that functions in a manner similar to a naturally occurring amino acid.

"Conservative amino acid substitution" refers to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Conservative amino acids substitution groups include: valine-leucine-isoleucine, phenylalanine-tyrosine, lysine-arginine, alanine-valine, and asparagine-glutamine.

The phrase "nucleic acid sequence" refers to a single or double-stranded polymer of deoxyribonucleotide or ribonucleotide bases read from the 5' to the 3' end or an analog thereof.

The term "encoding" refers to a polynucleotide sequence encoding one or more amino acids. The term does not require a start or stop codon. An amino acid sequence can be encoded in any one of six different reading frames provided by a polynucleotide sequence.

The term "promoter" refers to regions or sequence located upstream and/or downstream from the start of transcription that are involved in recognition and binding of RNA polymerase and other proteins to initiate transcription.

A "vector" refers to a polynucleotide, which when independent of the host chromosome, is capable of replication in a host organism. Examples of vectors include plasmids. Vectors typically have an origin of replication. Vectors can comprise, e.g., transcription and translation terminators, transcription and translation initiation sequences, and promoters useful for regulation of the expression of the particular nucleic acid.

The term "recombinant" when used with reference, e.g., to a cell, or nucleic acid, protein, or vector, indicates that the cell, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (nonrecombinant) form of the cell or express native genes that are otherwise abnormally expressed, under-expressed or not expressed at all.

The phrase "binds" to a polypeptide, when referring to a monomer or multimer, refers to a binding reaction that can be determinative of the presence of the polypeptide in a heterogeneous population of proteins (e.g., a cell or tissue lysate) and other biologics. Thus, under standard conditions or assays used in antibody binding assays, the specified monomer or multimer binds to a particular target molecule above background (e.g., 2×, 5×, 10× or more above background). A monomer or multimer may specifically (or selectively) bind to a particular target molecule when that binding is above background and does not bind in a significant amount to other molecules present in the sample.

The terms "identical" or percent "identity," in the context of two or more nucleic acids or polypeptide sequences, refer to two or more sequences or subsequences that are the same. "Substantially identical" refers to two or more nucleic acids or polypeptide sequences having a specified percentage of amino acid residues or nucleotides that are the same (i.e., 60% identity, optionally 65%, 70%, 75%, 80%, 85%, 90%, or 95% identity over a specified region, or, when not specified, over the entire sequence), when compared and aligned for maximum correspondence over a comparison window, or designated region as measured using one of the following sequence comparison algorithms or by manual alignment and visual inspection. This definition also refers to the complement of a test sequence. Optionally, the identity or substantial identity exists over a region that is at least about 50 nucleotides or amino acids in length, or over a region that is 75 to 100, 100 to 500, 1000 or more nucleotides or amino acids in length, or if not specified, over the length of a sequence. The present invention provides polypeptides comprising IL-6 binding sequences, wherein the IL-6 binding sequences are substantially identical (e.g., at least 65%, 70%, 75%, 80%, 85%, 90%, or 95% identical) to at least one IL-6 binding sequences as provided herein, including but not limited to, any of SEQ ID NOS:27-33.

A polynucleotide or amino acid sequence is "heterologous to" a second sequence if the two sequences are not linked in the same manner as found in naturally occurring sequences. For example, a promoter operably linked to a heterologous coding sequence refers to a coding sequence which is different from any naturally occurring allelic variants. The term "heterologous linker," when used in reference to a multimer, indicates that the multimer comprises a linker and a monomer that are not found in the same relationship to each other in nature (e.g., they form a non-naturally occurring fusion protein).

"Percentage of sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith and Waterman (1970) *Adv. Appl. Math.* 2:482c, by the homology alignment algorithm of Needleman and Wunsch (1970) *J. Mol. Biol.* 48:443, by the search for similarity method of Pearson and Lipman (1988) *Proc. Nat'l. Acad. Sci. USA* 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Ausubel et al., *Current Protocols in Molecular Biology* (1995 supplement)).

One example of a useful algorithm is the BLAST 2.0 algorithm, which is described in Altschul et al. (1990) *J. Mol. Biol.* 215:403-410, respectively. Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff and Henikoff (1989) *Proc. Natl. Acad. Sci. USA* 89:10915) alignments (B) of 50, expectation (E) of 10, M=5, N=−4, and a comparison of both strands.

The BLAST algorithm also performs a statistical analysis of the similarity between two sequences (see, e.g., Karlin and Altschul (1993) *Proc. Natl. Acad. Sci. USA* 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

As used herein, the term "patient" and "subject" are used interchangeably to refer to, e.g., a mammal, including, but not limited to, a human, primate, mouse, pig, cow, goat, rabbit, rat, guinea pig, hamster, horse, sheep; or a non-mammalian vertebrate such as a bird (e.g., a chicken or duck), fish, or invertebrate.

As used herein, the term "treat," "treating" or "treatment" refers to the administration of therapy to an individual who already manifests at least one symptom of a disease, condition, or disorder (e.g., inflammation), or who has previously manifested at least one symptom of a disease, condition, or disorder.

As used herein, the term "ameliorate," "ameliorating," and "ameliorative" refers to the administration of therapy to an individual who already manifests at least one symptom of a disease, condition, or disorder (e.g., inflammation), or who has previously manifested at least one symptom of a disease, condition, or disorder, to lessen at least one symptom of the disease, condition, or disorder.

The term "prevent," "preventing" and "prevention" refers to the administration of therapy an individual who may ultimately manifest at least one symptom of a disease or condition (e.g., inflammation) but who has not yet done so, to reduce the chance that the individual will develop the symptom of a disease or condition over a given period of time. Such a reduction may be reflected, for example, in a delayed onset of the at least one symptom of a disease or condition in the patient.

As used herein, the term "administer," "administering," or "administration" refers to any process of introducing a polypeptide into or onto the body of a patient in vivo, or into or onto a cell in an in vitro or ex vivo assay.

BRIEF DESCRIPTION OF THE DRAWINGS

FIG. 1 schematically illustrates the alignment of partial amino acid sequences from a variety of the LDL-receptor class A-domains (SEQ ID NOS:38-50) to demonstrate the conserved cysteines. The connectivity of cysteines in the three disulfide bonds of the folded domain is illustrated schematically on the consensus sequence (SEQ ID NO:51). Residues whose side-chains contribute to calcium binding are designated with an asterisk in the consensus sequence.

FIG. 3 indicates some of the ligands recognized by naturally occurring members of the LDL-receptor family, which include inhibitors, proteases, protease complexes, vitamin-carrier complexes, proteins involved in lipoprotein metabolism, non-human ligands, antibiotics, viruses, and others.

FIG. 6 depicts an alignment of A domains (SEQ ID NOS: 53-269). At the top of the figure, small letters (a-q) indicate conserved residues.

FIG. 7 illustrates various possible antibody-monomer or multimer conformations. In some embodiments, the monomer or multimer replaces the Fab fragment of the antibody.

DETAILED DESCRIPTION OF THE INVENTION

I. Introduction

Figure 2:
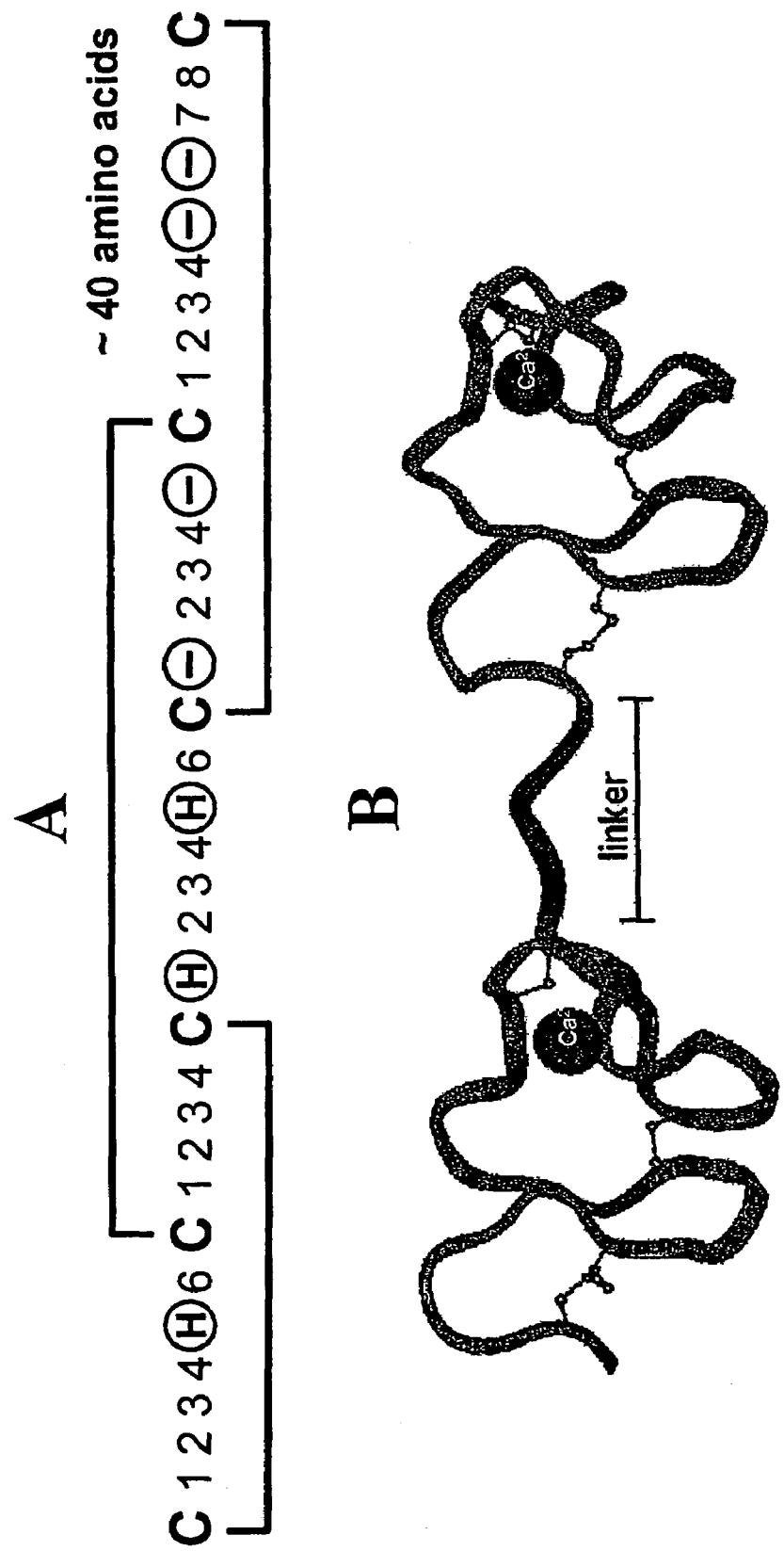
FIG. 2, panel A schematically illustrates an example of an A-domain. Panel A schematically illustrates conserved amino acids in an A-domain (SEQ ID NO:52) of about 40 amino acids long. The conserved cysteine residues are indicated by C, and the conserved negatively charged amino acids are indicated by a circle with a minus ("−") sign. Circles with an "H" indicate conserved hydrophobic residues. Panel B schematically illustrates two folded A-domains connected via a linker. Panel B also indicates two calcium binding sites, dark circles with $Ca^{+2}$, and three disulfide bonds within each folded A-domain for a total of 6 disulfide bonds.

The present invention provides for non-naturally occurring proteins that bind to IL-6. Generally, the proteins of the present invention comprise one or more domains that bind to IL-6. These domains may be readily identified using a variety of polypeptide scaffolds to generate a plurality of polypeptide variants and then selecting a variant that binds to IL-6. The present invention therefore also provides for selecting a protein that binds to IL-6. Proteins that bind IL-6 are useful, e.g., for treating, e.g., autoimmune and inflammatory diseases, cancer, metabolic/endocrine diseases, cardiovascular disease, and neurological diseases. The polypeptides of the invention are also useful to detect and quantify IL-6. The amino acid sequence of IL-6 is known and is displayed in SEQ ID NO: 1.

IL-6 functions by binding the IL-6 receptor complex. Accordingly, in some embodiments, the polypeptides of the invention comprise at least one monomer domain that inhibits binding of IL-6 to its receptor, i.e., that acts as an antagonist to prevent IL-6 from binding and/or activating the IL-6 receptor complex.

The present invention provides for polypeptides comprising single domains or multimers of the domains, including without limitation dimers, tirimers, homomultimers, and/or homodimers. In some embodiments, all of the domains of the multimer bind IL-6. In some of these embodiments, each of the domains are identical and bind to the same portion (i.e., "epitope") of IL-6. In other embodiments, at least some of the domains in the multimer bind to different portions of IL-6. In yet other embodiments, at least some of the domains of the polypeptide bind to a molecule or molecules other than IL-6 (e.g., a blood factor such as serum albumin, immunoglobulin, or erythrocytes).

II. Monomers

Monomer domains can be polypeptide chains of any size. In some embodiments, monomer domains have about 25 to about 500, about 30 to about 200, about 30 to about 100, about 35 to about 50, about 35 to about 100, about 90 to about 200, about 30 to about 250, about 30 to about 60, about 9 to about 150, about 100 to about 150, about 25 to about 50, or about 30 to about 150 amino acids. Similarly, a monomer domain of the present invention can comprise, e.g., from about 30 to about 200 amino acids; from about 25 to about 180 amino acids; from about 40 to about 150 amino acids; from about 50 to about 130 amino acids; or from about 75 to about 125 amino acids. Monomer domains can typically maintain a stable conformation in solution, and are often heat stable, e.g., stable at 95° C. for at least 10 minutes without losing binding affinity. Sometimes, monomer domains can fold independently into a stable conformation. In one embodiment, the stable conformation is stabilized by ions (e.g., such as metal or calcium ions). The stable conformation can optionally contain disulfide bonds (e.g., at least one, two, or three or more disulfide bonds). The disulfide bonds can optionally be formed between two cysteine residues. In some embodiments, monomer domains, or monomer domain variants, are substantially identical to the sequences exemplified.

A. IL-6 Binders

In some aspects, the invention provides monomer domains that bind to (e.g., selectively binds) a IL-6 polypeptide or a portion thereof. A portion of a polypeptide can be, e.g., at least 5, 10, 15, 20, 30, 50, 100, or more contiguous amino acids of the polypeptide. In some embodiments, the monomers of the invention will bind to IL-6 with a affinity stronger than $10^{-3}$ M (e.g, $10^{-4}$ M, etc.). In some embodiments, the affinity is stronger than $10^{-4}$ M, $10^{-5}$ M, $10^{-6}$ M, $10^{-7}$ M, or $10^{-8}$ M.

A large number of IL-6 binding sequences having an A domain scaffold were generated. As described in detail in the examples, seven families (i.e., Families 1-7, or "Fam 1-7") of monomer domains that bind to IL-6 have been identified. The consensus motifs generated based on these families indicate common amino acid residues between IL-6 binders. Those of skill in the art will appreciate that positions where there is no consensus (marked with an "X") can be any amino acid. In some embodiments, the amino acid at "X" positions will be selected from amino acids in the analogous position of one of the exemplified IL-6 binders either from the same family or a different family.

Family 1 has the following consensus motif (SEQ ID NO:27):

```
CX [AS] [DN] EFXCXXGXC [ILV] XXAXXCDGV [DN]
DCXDNSDEXXC [AST] XX [AST]
```

Exemplary sequences comprising the IL-6 Family 1 motif are displayed in the examples. References to IL-6 binding monomers or multimers encompass each Family 1 sequence exemplified in the examples.

Family 2 has the following consensus motif (SEQ ID NO:28):

```
CXXXQFXC [DN] NGXCVPXXWXCDG [DE] [DN] DCXD [DN]
SDEXXCXXP [AST]
```

Exemplary sequences comprising the IL-6 Family 2 motif are displayed in the examples. References to IL-6 binding monomers or multimers encompass each Family 2 sequence exemplified in the examples.

Family 3 has the following consensus motif (SEQ ID NO:29):

```
    CXXXQFQCXSG [W, Y] C [I, L, F] XXXW [W, L]
    CDGXNDCEDXSDEXXC
```

Exemplary sequences comprising the IL-6 Family 3 motif are displayed in the examples. References to IL-6 binding monomers or multimers encompass each Family 3 sequence exemplified in the examples.

Family 4 has the following consensus motif (SEQ ID NO:30):

```
CXXX [EQ] FXCXXGXC [ILV] XXXXXCDGX [DN] DCXDXSDEXX (XX) C
```

Exemplary sequences comprising the IL-6 Family 4 motif are displayed in the examples. References to IL-6 binding monomers or multimers encompass each Family 4 sequence exemplified in the examples.

Family 5 has the following consensus motif (SEQ ID NO:31):

```
CX [A, P] X [E, Q] FXCXXGQC [I, L] PXXXXCDGX [D,

N] DCXDXSDEXXC
```

Exemplary sequences comprising the IL-6 Family 5 motif are displayed in the examples. References to IL-6 binding monomers or multimers encompass each Family 5 sequence exemplified in the examples.

Family 6 has the following consensus motif (SEQ ID NO:32):

```
    CXXX [EQ] FXCX (X) SXXC [ILV] XX [DN] W [ILV]

CDGVNDCXDXSDEXGCXXXT
```

Exemplary sequences comprising the IL-6 Family 6 motif are displayed in the examples. References to IL-6 binding monomers or multimers encompass each Family 6 sequence exemplified in the examples.

Family 7 has the following consensus motif (SEQ ID NO:33):

```
CL [AS] X [EQ] FXCXNGXCIP [KQR] XWVCDGDNDC [ILV]

DXSDE (P) XXCX [EKQ] XT
```

Exemplary sequences comprising the IL-6 Family 7 motif are displayed in the examples. References to IL-6 binding monomers or multimers encompass each Family 7 sequence exemplified in the examples.

As described herein, monomer domains can be linked to form multimers that bind the same target. The present invention provides polypeptides comprising both homo- (i.e., at least two identical monomers) and hetero- (i.e., different monomers that bind the same target) multimers. Exemplary dimers and trimers are displayed in the examples.

Several IL-6 trimer family motifs were identified based on similarity between sequences. See Example 7. The consensus motifs generated based on these families indicate common amino acid residues between IL-6 trimers. Those of skill in the art will appreciate that positions where there is no consensus (marked with an "X") can be any amino acid. In some embodiments, the amino acid at "X" positions will be selected from amino acids in the analogous position of one of the exemplified IL-6 binders either from the same family or a different family.

Exemplary IL-6-binding trimers include the following (SEQ ID NOS:270-278):

CLPDQFRCGNGQCIPLDWVCDGVNDCPDDSDEEGCPPRTCAPSQFQCGSG

YCISQRWVCDGENDCEDGSDEANCAGSVPTCPSDEFRCRNGRCIPRAWRC

DGVNDCADNSDEEDCTEHT;

CLPDQFRCGNGQCIPLDWVCDGVNDCADNSDETGCPTRTCLPSQFQCGSG

YCISQRWVCDGENDCEDGSDEANCAGSVPTCPSDEFRCRNGRCIPRAWRC

DGVNDCADNSDEEDCTEHT;

CRADEFQCGSGRCVPADWLCDGVNDCADNSDETGCPTRTCLPSQFQCGSG

YCISQRWVCDGENDCEDGSDEANCAGSVPTCPSDEFRCRNGRCIPRAWRC

DGVNDCADNSDEEDCTEHT;

CLPDQFRCGNGQCIPLDWVCDGVNDCEDDSDEESCPPRTCLPDQFQCGSG

YCLPQRWVCDGENDCEDGSDEANCAGSVPTCPSDEFRCRNGRCIPRAWRC

DGVNDCADNSDEEDCTQHT;

CQANEFTCSSGNCLSPALLCDGVDDCGDNSDETYCASPAPTCLPSQFQCG

SGYCISQRWVCDGENDCEDSSDEANCAGSVPTCQPGEFTCESGRCLPLRW

LCDGEDDCVDSSDEASCQPPT;

CLPDQFRCGNGQCIPLDWVCDGVNDCEDDSDEESCPPRTCLPDQFQCGSG

YCLPQRWVCDGENDCEDGSDEANCAGSVPTCPSDEFRCRNGRCIPRAWRC

DGVNDCADNSDEADCAAPT;

CLPDQFRCGNGQCIPLDWVCDGVNDCEDDSDEESCPPHTCLPDQFQCGSG

YCLSQRWVCDGENDCEDGSDEANCAGSVPTCPSDEFRCRNGRCIPRAWRC

DGVNDCADNSDEEDCTEHT;

CESDQFQCDSGHCVPLNWVCDGVNDCVDGSDEAGCPPRTCLPGQFQCGSG

YCISQRWVCDGENDCEDGSDEANCAGSVPTCPSDEFRCRNGRCIPRAWRC

DGVNDCADNSDEEDCTEHT;
and

CGASQFQCGSGYCISQRWVCDGENDCEDSSDEANCAGSVPTCLPSEFQCR

DSKICLSADWLCDGVNDCADNSDEEGCPPPTCLPDQFQCGSGYCLPQAWV

CDGENDCEDGSDETNCPART.

Additional exemplary IL-6-binding trimers include the following (SEQ ID NOS: 934-935):

MAGPAYPYDVPDYAPGLEASGGSCLPDQFRCGNGQCIPLDWVCDGVNDCP

DDSDEEGCPPRTCAPSQFQCGSGYCISQRWVCDGENDCEDGSDEANCAGS

VPTCPSDEFRCRNGRCIPRAWRCDGVNDCADNSDEEDCTEHTSLQKASGA

LEHHHHHHHH
and

MAGPAYPYDVPDYAPGLEASGGSCLLAHQFLCGNGQCLPLDWVCDGVTDC

PDDSDEVGCPPRTCAPSHFQCGSGYCISQSWVCDGEYDCEDGSDEASCAG

SVPSCPSDEFQCRNGRCIPRPWRCDGVNDCADNSDEEDCTEHTSLQKASG

ALEHHHHHHH.

B. IgG Binders and Serum Half-Life Extension

The present invention provides a method for extending the serum half-life of a therapeutic protein, including, e.g., a monomer or a multimer of the invention or a protein of interest in an animal. The therapeutic protein can be any protein with therapeutic, prophylactic, or otherwise desirable functionality. This method comprises first providing a monomer domain that has been identified as a binding protein that specifically binds to a half-life extender such as a blood-carried molecule or cell, such as serum albumin (e.g., human serum albumin), IgG, red blood cells, etc. The half-life extender-binding monomer is then linked to another monomer domain that has a binding affinity for the protein of interest (e.g., IL-6 or a different target). This complex formation results in the half-life extension protecting the monomer, the multimer and/or bound protein(s) from proteolytic degradation and/or other removal of the monomer, the multimer and/or protein(s) and thereby extending the half-life of the protein and/or monomer/multimer. One variation of this use of the invention includes the half-life extender-binding monomer covalently linked to the protein of interest. The protein of interest may include a monomer domain, a multimer of monomer domains, or a synthetic drug. Alternatively, monomers that bind to either immunoglobulins or erythrocytes could be generated using the above method and could be used for half-life extension.

The invention includes half-life extender-binding multimers that are typically multimers of at least two domains, chimeric domains, or mutagenized domains (i.e., one that binds to IL-6 and one that binds to the blood-carried molecule or cell). Suitable domains include all of those described herein, that are further screened and selected for binding to a half-life extender. The half-life extender-binding multimers are generated in accordance with the methods for making multimers described herein, using, for example, monomer domains pre-screened for half-life extender-binding activity. The serum half-life of a molecule can be extended to be, e.g., at least 1, 2, 3, 4, 5, 10, 20, 30, 40, 50, 60, 70 80, 90, 100, 150, 200, 250, 400, 500 or more hours.

Thus, the invention provides monomer domains that bind to (e.g., selectively binds) a blood factor to thereby extend the half-life of other monomer, multimer, or protein of interest to which it may be linked. These blood factors include, but are not limited to, serum albumin, immunoglobulin, or erythrocytes. In some embodiments, the monomers of the invention will bind to a blood factor with an affinity of less than $10^{-3}$ M (i.e., binds stronger than an affinity of $10^{-3}$ M). In some embodiments, the affinity is less than $10^{-4}$ M, $10^{-5}$ M, $10^{-6}$ M, $10^{-7}$ M, or $10^{-8}$ M.

In some embodiments, the monomer domains bind to an immunoglobulin polypeptide or a portion thereof.

Although the invention embodies other monomer domains that extend half-life, two families (i.e., A domain IgG Families 2 and 3) of monomer domains that bind to immunoglobulin have been identified.

IgG Family 2 has the following consensus motif (SEQ ID NO:279):

```
[EQ] FXCRX [ST] XRC [IV] XXXW [ILV] CDGXXDCXD [DN]
SDE
```

Exemplary sequences comprising the IgG Family 2 motif are displayed in the examples. References to IgG binding monomers or multimers encompass each Family 2 sequence exemplified in the examples.

IgG Family 3 has either of the two following consensus motifs (SEQ ID NOS:280 and 281):

```
CXSSGRCIPXXWVCDGXXDCRDXSDE; or
CXSSGRCIPXXWLCDGXXDCRDXSDE
```

Exemplary sequences comprising the IgG Family 3 motif are displayed in the examples. References to IgG binding monomers or multimers encompass each Family 3 sequence exemplified in the examples.

In some embodiments, a multimer comprises one or more monomer domain(s) that bind immunoglobulin. For example, such a multimer may be a monomer domain, a homodimer or a heterodimer. Exemplary monomers include those with the sequences:

(SEQ ID NO: 930)
CHPTGQFRCRSSGRCVSPTWVCDGDNDCGDNSDEENCSAPASEPPGSL;

(SEQ ID NO: 931)
CLSSEFQCQSSGRCIPLAWVCDGDNDCRDDSDEKSCKPRT;

(SEQ ID NO: 932)
CHPTGQFRCRSSGRCVSPTWVCDGDNDCGDNSDEENCKPRT.

Exemplary sequences of a homodimer that binds to immunoglobulin include the following (SEQ ID NOS: 936-940):

ATGGCCGGTCCGGCCTACCCGTATGATGTTCCGGATTATGCCCCGGGTCT

GGAGGCGTCTGGTGGTTCGTGTCACCCTACCGGCCAATTTAGATGCCGCA

GTAGCGGCAGATGCGTTTCACCGACCTGGGTTTGCGACGGCGATAATGAT

TGTGGGGACAACTCGGATGAAGAAAACTGTAGCGCGCCAGCATCTGAACC

GCCGGGTTCCCTGTGTCACCCTACCGGCCAATTTAGATGCCGCAGTAGCG

GCAGATGCGTTTCACCGACCTGGGTTTGCGACGGCGATAATGATTGTGGG

GACAACTCGGATGAAGAAAACTGTAGCGCGCCAGCATCTGAACCGCCGGG

TTCCCTGTCATTGCAGAAGGCCTCTGGGGCCCTCGAGCACCACCACCACC

ACCACCACCAC

MAGPAYPYDVPDYAPGLEASGGSCHPTGQFRCRSSGRCVSPTWVCDGDND

CGDNSDEENCSAPASEPPGSLCHPTGQFRCRSSGRCVSPTWVCDGDNDCG

DNSDEENCSAPASEPPGSLSLQKASGALEHHHHHHHH

ATGAAACACTCTGGTGGTTCGTGTCACCCTACCGGCCAATTTAGATGCCG

-continued

CAGTAGCGGCAGATGCGTTTCACCGACCTGGGTTTGCGACGGCGATAATG

ATTGTGGGGACAACTCGGATGAAGAAAACTGTAGCGCGCCAGCATCTGAA

CCGCCGGGTTCCCTGTGTCACCCTACCGGCCAATTTAGATGCCGCAGTAG

CGGCAGATGCGTTTCACCGACCTGGGTTTGCGACGGCGATAATGATTGTG

GGGACAACTCGGATGAAGAAAACTGTAGCGCGCCAGCATCTGAACCGCCG

GGTTCCCTGTCATTGCAGTAGGCCTCTGGGGCCCTCGAGCACCACCACCA

CCACCACCACCAC

MKHSGGSCHPTGQFRCRSSGRCVSPTWVCDGDNDCGDNSDEENCSAPASE

PPGSLCHPTGQFRCRSSGRCVSPTWVCDGDNDCGDNSDEENCSAPASEPP

GSLSLQ

CHPTGQFRCRSSGRCVSPTWVCDGDNDCGDNSDEENCSAPASEPPGSLCH

PTGQFRCRSSGRCVSPTWVCDGDNDCGDNSDEENCSAPASEPPGSL

Monomer domains that bind to red blood cells (RBC) or serum albumin (CSA) are described in U.S. Patent Publication No. 2005/0048512, and include, e.g. SEQ ID NOS:282-285:

RBCA
CRSSQFQCNDSRICIPGRWRCDGDNDCQDGSDETGCGDSHILPFSTPGPS

T

RBCB
CPAGEFPCKNGQCLPVTWLCDGVNDCLDGSDEKGCGRPGPGATSAPAA

RBC11
CPPDEFPCKNGQCIPQDWLCDGVNDCLDGSDEKDCGRPGPGATSAPAA

CSA-A8
CGAGQFPCKNGHCLPLNLLCDGVNDCEDNSDEPSELCKALT

The half-life extending monomer domain of the invention can be linked to the N-, C-terminus or both of a target molecule (e.g., IL-6-binding)-binding monomer domain. Exemplary sequences of multimeric polypeptides that bind to IL-6 and IgG include the following (SEQ ID NOS:286-339):

CLSSEFQCQSSGRCIPLAWVCDGDNDCRDDSDEKSCKPRTCLPDQFRCGN

GQCIPLDWVCDGVNDCPDDSDEEGCPPRTCAPSQFQCGSGYCISQRWVCD

GENDCEDGSDEANCAGSVPTCPSDEFRCRNGRCIPRAWRCDGVNDCADNS

DEEDCTEHT

CLSSEFQCQSSGRCIPLAWVCDGDNDCRDDSDEKSCKPRTCLPDQFRCGN

GQCIPLDWVCDGVNDCADNSDETGCPTRTCLPSQFQCGSGYCISQRWVCD

GENDCEDGSDEANCAGSVPTCPSDEFRCRNGRCIPRAWRCDGVNDCADNS

DEEDCTEHT

CLSSEFQCQSSGRCIPLAWVCDGDNDCRDDSDEKSCKPRTCRADEFQCGS

GRCVPADWLCDGVNDCADNSDETGCPTRTCLPSQFQCGSGYCISQRWVCD

GENDCEDGSDEANCAGSVPTCPSDEFRCRNGRCIPRAWRCDGVNDCADNS

DEEDCTEHT

CLSSEFQCQSSGRCIPLAWVCDGDNDCRDDSDEKSCKPRTCLPDQFRCGN

GQCIPLDWVCDGVNDCEDDSDEESCPPRTCLPDQFQCGSGYCLPQRWVCD
GENDCEDGSDEANCAGSVPTCPSDEFRCRNGRCIPRAWRCDGVNDCADNS
DEEDCTQHT CLSSEFQCQSSGRCIPLAWVCDGDNDCRDDSDEKSCKPRTCQANEFTCSS
GNCLSPALLCDGVDDCGDNSDETYCASPAPTCLPSQFQCGSGYCISQRWV
CDGENDCEDSSDEANCAGSVPTCQPGEFTCESGRCLPLRWLCDGEDDCVD
SSDEASCQPPT CLSSEFQCQSSGRCIPLAWVCDGDNDCRDDSDEKSCKPRTCLPDQFRCGN
GQCIPLDWVCDGVNDCEDDSDEESCPPRTCLPDQFQCGSGYCLPQRWVCD
GENDCEDGSDEANCAGSVPTCPSDEFRCRNGRCIPRAWRCDGVNDCADNS
DEADCAAPT CLSSEFQCQSSGRCIPLAWVCDGDNDCRDDSDEKSCKPRTCLPDQFRCGN
GQCIPLDWVCDGVNDCEDDSDEESCPPHTCLPDQFQCGSGYCLSQRWVCD
GENDCEDGSDEANCAGSVPTCPSDEFRCRNGRCIPRAWRCDGVNDCADNS
DEEDCTEHT CLSSEFQCQSSGRCIPLAWVCDGDNDCRDDSDEKSCKPRTCESDQFQCDS
GHCVPLNWVCDGVNDCVDGSDEAGCPPRTCLPGQFQCGSGYCISQRWVCD
GENDCEDGSDEANCAGSVPTCPSDEFRCRNGRCIPRAWRCDGVNDCADNS
DEEDCTEHT CLSSEFQCQSSGRCIPLAWVCDGDNDCRDDSDEKSCKPRTCGASQFQCGS
GYCISQRWVCDGENDCEDSSDEANCAGSVPTCLPSEFQCRDSKICLSADW
LCDGVNDCADNSDEEGCPPPTCLPDQFQCGSGYCLPQAWVCDGENDCEDG
SDETNCPART CHPTGQFRCRSSGRCVSPTWVCDGDNDCGDNSDEENCKPRTCLPDQFRCG
NGQCIPLDWVCDGVNDCPDDSDEEGCPPRTCAPSQFQCGSGYCISQRWVC
DGENDCEDGSDEANCAGSVPTCPSDEFRCRNGRCIPRAWRCDGVNDCADN
SDEEDCTEHT CHPTGQFRCRSSGRCVSPTWVCDGDNDCGDNSDEENCKPRTCLPDQFRCG
NGQCIPLDWVCDGVNDCADNSDETGCPTRTCLPSQFQCGSGYCISQRWVC
DGENDCEDGSDEANCAGSVPTCPSDEFRCRNGRCIPRAWRCDGVNDCADN
SDEEDCTEHT CHPTGQFRCRSSGRCVSPTWVCDGDNDCGDNSDEENCKPRTCRADEFQCG
SGRCVPADWLCDGVNDCADNSDETGCPTRTCLPSQFQCGSGYCISQRWVC
DGENDCEDGSDEANCAGSVPTCPSDEFRCRNGRCIPRAWRCDGVNDCADN
SDEEDCTEHT CHPTGQFRCRSSGRCVSPTWVCDGDNDCGDNSDEENCKPRTCLPDQFRCG
NGQCIPLDWVCDGVNDCEDDSDEESCPPRTCLPDQFQCGSGYCLPQRWVC
DGENDCEDGSDEANCAGSVPTCPSDEFRCRNGRCIPRAWRCDGVNDCADN
SDEEDCTQHT

CHPTGQFRCRSSGRCVSPTWVCDGDNDCGDNSDEENCKPRTCQANEFTCS

SGNCLSPALLCDGVDDCGDNSDETYCASPAPTCLPSQFQCGSGYCISQRW
VCDGENDCEDSSDEANCAGSVPTCQPGEFTCESGRCLPLRWLCDGEDDCV
DSSDEASCQPPT

CHPTGQFRCRSSGRCVSPTWVCDGDNDCGDNSDEENCKPRTCLPDQFRCG
NGQCIPLDWVCDGVNDCEDDSDEESCPPRTCLPDQFQCGSGYCLPQRWVC
DGENDCEDGSDEANCAGSVPTCPSDEFRCRNGRCIPRAWRCDGVNDCADN
SDEADCAAPT

CHPTGQFRCRSSGRCVSPTWVCDGDNDCGDNSDEENCKPRTCLPDQFRCG
NGQCIPLDWVCDGVNDCEDDSDEESCPPHTCLPDQFQCGSGYCLSQRWVC
DGENDCEDGSDEANCAGSVPTCPSDEFRCRNGRCIPRAWRCDGVNDCADN
SDEEDCTEHT

CHPTGQFRCRSSGRCVSPTWVCDGDNDCGDNSDEENCKPRTCESDQFQCD
SGHCVPLNWVCDGVNDCVDGSDEAGCPPRTCLPGQFQCGSGYCISQRWVC
DGENDCEDGSDEANCAGSVPTCPSDEFRCRNGRCIPRAWRCDGVNDCADN
SDEEDCTEHT

CHPTGQFRCRSSGRCVSPTWVCDGDNDCGDNSDEENCKPRTCGASQFQCG
SGYCISQRWVCDGENDCEDSSDEANCAGSVPTCLPSEFQCRDSKICLSAD
WLCDGVNDCADNSDEEGCPPPTCLPDQFQCGSGYCLPQAWVCDGENDCED
GSDETNCPART

CLSSEFQCQSSGRCIPLAWVCDGDNDCRDDSDEKSCSAPASEPPGSLCLP
DQFRCGNGQCIPLDWVCDGVNDCPDDSDEEGCPPRTCAPSQFQCGSGYCI
SQRWVCDGENDCEDGSDEANCAGSVPTCPSDEFRCRNGRCIPRAWRCDGV
NDCADNSDEEDCTEHT

CLSSEFQCQSSGRCIPLAWVCDGDNDCRDDSDEKSCSAPASEPPGSLCLP
DQFRCGNGQCIPLDWVCDGVNDCADNSDETGCPTRTCLPSQFQCGSGYCI
SQRWVCDGENDCEDGSDEANCAGSVPTCPSDEFRCRNGRCIPRAWRCDGV
NDCADNSDEEDCTEHT

CLSSEFQCQSSGRCIPLAWVCDGDNDCRDDSDEKSCSAPASEPPGSLCRA
DEFQCGSGRCVPADWLCDGVNDCADNSDETGCPTRTCLPSQFQCGSGYCI
SQRWVCDGENDCEDGSDEANCAGSVPTCPSDEFRCRNGRCIPRAWRCDGV
NDCADNSDEEDCTEHT

CLSSEFQCQSSGRCIPLAWVCDGDNDCRDDSDEKSCSAPASEPPGSLCLP
DQFRCGNGQCIPLDWVCDGVNDCEDDSDEESCPPRTCLPDQFQCGSGYCL
PQRWVCDGENDCEDGSDEANCAGSVPTCPSDEFRCRNGRCIPRAWRCDGV
NDCADNSDEEDCTQHT

CLSSEFQCQSSGRCIPLAWVCDGDNDCRDDSDEKSCSAPASEPPGSLCQA
NEFTCSSGNCLSPALLCDGVDDCGDNSDETYCASPAPTCLPSQFQCGSGY
CISQRWVCDGENDCEDSSDEANCAGSVPTCQPGEFTCESGRCLPLRWLCD
GEDDCVDSSDEASCQPPT

CLSSEFQCQSSGRCIPLAWVCDGDNDCRDDSDEKSCSAPASEPPGSLCLP

DQFRCGNGQCIPLDWVCDGVNDCEDDSDEESCPPRTCLPDQFQCGSGYCL
PQRWVCDGENDCEDGSDEANCAGSVPTCPSDEFRCRNGRCIPRAWRCDGV
NDCADNSDEADCAAPT

CLSSEFQCQSSGRCIPLAWVCDGDNDCRDDSDEKSCSAPASEPPGSLCLP
DQFRCGNGQCIPLDWVCDGVNDCEDDSDEESCPPHTCLPDQFQCGSGYCL
SQRWVCDGENDCEDGSDEANCAGSVPTCPSDEFRCRNGRCIPRAWRCDGV
NDCADNSDEEDCTEHT

CLSSEFQCQSSGRCIPLAWVCDGDNDCRDDSDEKSCSAPASEPPGSLCES
DQFQCDSGHCVPLNWVCDGVNDCVDGSDEAGCPPRTCLPGQFQCGSGYCI
SQRWVCDGENDCEDGSDEANCAGSVPTCPSDEFRCRNGRCIPRAWRCDGV
NDCADNSDEEDCTEHT

CLSSEFQCQSSGRCIPLAWVCDGDNDCRDDSDEKSCSAPASEPPGSLCGA
SQFQCGSGYCISQRWVCDGENDCEDSSDEANCAGSVPTCLPSEFQCRDSK
ICLSADWLCDGVNDCADNSDEEGCPPPTCLPDQFQCGSGYCLPQAWVCDG
ENDCEDGSDETNCPART

CHPTGQFRCRSSGRCVSPTWVCDGDNDCGDNSDEENCSAPASEPPGSLCL
PDQFRCGNGQCIPLDWVCDGVNDCPDDSDEEGCPPRTCAPSQFQCGSGYC
ISQRWVCDGENDCEDGSDEANCAGSVPTCPSDEFRCRNGRCIPRAWRCDG
VNDCADNSDEEDCTEHT

CHPTGQFRCRSSGRCVSPTWVCDGDNDCGDNSDEENCSAPASEPPGSLCL
PDQFRCGNGQCIPLDWVCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT

CHPTGQFRCRSSGRCVSPTWVCDGDNDCGDNSDEENCSAPASEPPGSLCR
ADEFQCGSGRCVPADWLCDGVNDCADNSDETGCPTRTCLPSQFQCGSGYC
ISQRWVCDGENDCEDGSDEANCAGSVPTCPSDEFRCRNGRCIPRAWRCDG
VNDCADNSDEEDCTEHT

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPRAWRCDG
VNDCADNSDEEDCTQHT

CHPTGQFRCRSSGRCVSPTWVCDGDNDCGDNSDEENCSAPASEPPGSLCQ
ANEFTCSSGNCLSPALLCDGVDDCGDNSDETYCASPAPTCLPSQFQCGSG
YCISQRWVCDGENDCEDSSDEANCAGSVPTCQPGEFTCESGRCLPLRWLC
DGEDDCVDSSDEASCQPPT

CHPTGQFRCRSSGRCVSPTWVCDGDNDCGDNSDEENCSAPASEPPGSLCL
PDQFRCGNGQCIPLDWVCDGVNDCEDDSDEESCPPRTCLPDQFQCGSGYC
LPQRWVCDGENDCEDGSDEANCAGSVPTCPSDEFRCRNGRCIPPAWRCDG
VNDCADNSDEADCAAPT

CHPTGQFRCRSSGRCVSPTWVCDGDNDCGDNSDEENCSAPASEPPGSLCL
PDQFRCGNGQCIPLDWVCDGVNDCEDDSDEESCPPHTCLPDQFQCGSGYC
LSQRWVCDGENDCEDGSDEANCAGSVPTCPSDEFRCRNGRCIPRAWRCDG
VNDCADNSDEEDCTEHT

CHPTGQFRCRSSGRCVSPTWVCDGDNDCGDNSDEENCSAPASEPPGSLCE
SDQFQCDSGHCVPLNWVCDGVNDCVDGSDEAGCPPRTCLPGQFQCGSGYC
ISQRWVCDGENDCEDGSDEANCAGSVPTCPSDEFRCRNGRCIPRAWRCDG
VNDCADNSDEEDCTEHT

CHPTGQFRCRSSGRCVSPTWVCDGDNDCGDNSDEENCSAPASEPPGSLCG
ASQFQCGSGYCISQRWVCDGENDCEDSSDEANCAGSVPTCLPSEFQCRDS
KICLSADWLCDGVNDCADNSDEEGCPPPTCLPDQFQCGSGYCLPQAWVCD
GENDCEDGSDETNCPART

CLPDQFRCGNGQCIPLDWVCDGVNDCPDDSDEEGCPPRTCAPSQFQCGSG
YCISQRWVCDGENDCEDGSDEANCAGSVPTCPSDEFRCRNGRCIPRAWRC
DGVNDCADNSDEEDCTEHTCLSSEFQCQSSGRCIPLAWVCDGDNDCRDDS
DEKSCKPRT

CLPDQFRCGNGQCIPLDWVCDGVNDCADNSDETGCPTRTCLPSQFQCGSG
YCISQRWVCDGENDCEDGSDEANCAGSVPTCPSDEFRCRNGRCIPRAWRC
DGVNDCADNSDEEDCTEHTCLSSEFQCQSSGRCIPLAWVCDGDNDCRDDS
DEKSCKPRT

CRADEFQCGSGRCVPADWLCDGVNDCADNSDETGCPTRTCLPSQFQCGSG
YCISQRWVCDGENDCEDGSDEANCAGSVPTCPSDEFRCRNGRCIPRAWRC
DGVNDCADNSDEEDCTEHTCLSSEFQCQSSGRCIPLAWVCDGDNDCRDDS
DEKSCKPRT

CLPDQFRCGNGQCIPLDWVCDGVNDCEDDSDEESCPPRTCLPDQFQCGSG
YCLPQRWVCDGENDCEDGSDEANCAGSVPTCPSDEFRCRNGRCIPRAWRC
DGVNDCADNSDEEDCTQHTCLSSEFQCQSSGRCIPLAWVCDGDNDCRDDS
DEKSCKPRT

CQANEFTCSSGNCLSPALLCDGVDDCGDNSDETYCASPAPTCLPSQFQCG
SGYCISQRWVCDGENDCEDSSDEANCAGSVPTCQPGEFTCESGRCLPLRW
LCDGEDDCVDSSDEASCQPPTCLSSEFQCQSSGRCIPLAWVCDGDNDCRD
DSDEKSCKPRT

CLPDQFRCGNGQCIPLDWVCDGVNDCEDDSDEESCPPRTCLPDQFQCGSG
YCLPQRWVCDGENDCEDGSDEANCAGSVPTCPSDEFRCRNGRCIPRAWRC
DGVNDCADNSDEADCAAPTCLSSEFQCQSSGRCIPLAWVCDGDNDCRDDS
DEKSCKPRT

CLPDQFRCGNGQCIPLDWVCDGVNDCEDDSDEESCPPHTCLPDQFQCGSG
YCLSQRWVCDGENDCEDGSDEANCAGSVPTCPSDEFRCRNGRCIPRAWRC
DGVNDCADNSDEEDCTEHTCLSSEFQCQSSGRCIPLAWVCDGDNDCRDDS
DEKSCKPRT

CESDQFQCDSGHCVPLNWVCDGVNDCVDGSDEAGCPPRTCLPGQFQCGSG

-continued

```
YCISQRWVCDGENDCEDGSDEANCAGSVPTCPSDEFRCRNGRCIPRAWRC

DGVNDCADNSDEEDCTEHTCLSSEFQCQSSGRCIPLAWVCDGDNDCRDDS

DEKSCKPRT

CGASQFQCGSGYCISQRWVCDGENDCEDSSDEANCAGSVPTCLPSEFQCR

DSKICLSADWLCDGVNDCADNSDEEGCPPPTCLPDQFQCGSGYCLPQAWV

CDGENDCEDGSDETNCPARTCLSSEFQCQSSGRCIPLAWVCDGDNDCRDD

SDEKSCKPRT

CLPDQFRCGNGQCIPLDWVCDGVNDCPDDSDEEGCPPRTCAPSQFQCGSG

YCISQRWVCDGENDCEDGSDEANCAGSVPTCPSDEFRCRNGRCIPRAWRC

DGVNDCADNSDEEDCTEHTCHPTGQFRCRSSGRCVSPTWVCDGDNDCGDN

SDEENCSAPASEPPGSL

CLPDQFRCGNGQCIPLDWVCDGVNDCADNSDETGCPTRTCLPSQFQCGSG

YCISQRWVCDGENDCEDGSDEANCAGSVPTCPSDEFRCRNGRCIPRAWRC

DGVNDCADNSDEEDCTEHTCHPTGQFRCRSSGRCVSPTWVCDGDNDCGDN

SDEENCSAPASEPPGSL

CRADEFQCGSGRCVPADWLCDGVNDCADNSDETGCPTRTCLPSQFQCGSG

YCISQRWVCDGENDCEDGSDEANCAGSVPTCPSDEFRCRNGRCIPRAWRC

DGVNDCADNSDEEDCTEHTCHPTGQFRCRSSGRCVSPTWVCDGDNDCGDN

SDEENCSAPASEPPGSL

CLPDQFRCGNGQCIPLDWVCDGVNDCEDDSDEESCPPRTCLPDQFQCGSG

YCLPQRWVCDGENDCEDGSDEANCAGSVPTCPSDEFRCRNGRCIPRAWRC

DGVNDCADNSDEEDCTQHTCHPTGQFRCRSSGRCVSPTWVCDGDNDCGDN

SDEENCSAPASEPPGSL

CQANEFTCSSGNCLSPALLCDVDDCGDNSDETYCASPAPTCLPSQFQCG

SGYCISQRWVCDGENDCEDSSDEANCAGSVPTCQPGEFTCESGRCLPLRW

LCDGEDDCVDSSDEASCQPPTCHPTGQFRCRSSGRCVSPTWVCDGDNDCG

DNSDEENCSAPASEPPGSL

CLPDQFRCGNGQCIPLDWVCDGVNDCEDDSDEESCPPRTCLPDQFQCGSG

YCLPQRWVCDGENDCEDGSDEANCAGSVPTCPSDEFRCRNGRCIPRAWRC

DGVNDCADNSDEADCAAPTCHPTGQFRCRSSGRCVSPTWVCDGDNDCGDN

SDEENCSAPASEPPGSL

CLPDQFRCGNGQCIPLDWVCDGVNDCEDDSDEESCPPHTCLPDQFQCGSG

YCLSQRWVCDGENDCEDGSDEANCAGSVPTCPSDEFRCRNGRCIPRAWRC

DGVNDCADNSDEEDCTEHTCHPTGQFRCRSSGRCVSPTWVCDGDNDCGDN

SDEENCSAPASEPPGSL

CESDQFQCDSGHCVPLNWVCDGVNDCVDGSDEAGCPPRTCLPGQFQCGSG

YCISQRWVCDGENDCEDGSDEANCAGSVPTCPSDEFRCRNGRCIPRAWRC

DGVNDCADNSDEEDCTEHTCHPTGQFRCRSSGRCVSPTWVCDGDNDCGDN

SDEENCSAPASEPPGSL

CGASQFQCGSGYCISQRWVCDGENDCEDSSDEANCAGSVPTCLPSEFQCR

DSKICLSADWLCDGVNDCADNSDEEGCPPPTCLPDQFQCGSGYCLPQAWV

CDGENDCEDGSDETNCPARTCHPTGQFRCRSSGRCVSPTWVCDGDNDCGD

NSDEENCSAPASEPPGSL
```

C. Discussion of Monomer Domains

Monomer domains that are particularly suitable for use in the practice of the present invention are cysteine-rich domains comprising disulfide bonds. Cysteine-rich domains employed in the practice of the present invention typically do not form an α helix, a β sheet, or a β-barrel structure. Typically, the disulfide bonds promote folding of the domain into a three-dimensional structure. Usually, cysteine-rich domains have at least two disulfide bonds, more typically at least three disulfide bonds. In some embodiments, at least 5, 10, 15 or 20% of the amino acids in a monomer domain are cysteines.

Domains can have any number of characteristics. For example, in some embodiments, the domains have low or no immunogenicity in an animal (e.g., a human). Domains can have a small size. In some embodiments, the domains are small enough to penetrate skin or other tissues. Domains can have a range of in vivo half-lives or stabilities.

Illustrative monomer domains suitable for use in the practice of the present invention include, e.g., an EGF-like domain, a Kringle-domain, a fibronectin type I domain, a fibronectin type II domain, a fibronectin type m domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF domain, a C2 domain, and other such domains known to those of ordinary skill in the art, as well as derivatives and/or variants thereof.

In some embodiments, suitable monomer domains (e.g. domains with the ability to fold independently or with some limited assistance) can be selected from the families of protein domains that contain β-sandwich or β-barrel three dimensional structures as defined by such computational sequence analysis tools as Simple Modular Architecture Research Tool (SMART), see Shultz et al., *SMART: a web-based tool for the study of genetically mobile domains*, (2000) *Nucleic Acids Research* 28(1):231-234) or CATH (see Pearl et. al., *Assigning genomic sequences to CATH*, (2000) *Nucleic Acids Research* 28(1):277-282).

In another embodiment, monomer domains of the present invention include domains other than a fibronectin type III domain, an anticalin domain and a Ig-like domain from CTLA-4. Some aspects of these domains are described in WO01/64942 entitled "Protein scaffolds for antibody mimics and other binding proteins" by Lipovsek et al., published on Sep. 7, 2001, WO99/16873 entitled "Anticalins" by Beste et al., published Apr. 8, 1999 and WO 00/60070 entitled "A polypeptide structure for use as a scaffold" by Desmet, et al., published on Oct. 12, 2000.

As described supra, monomer domains are optionally cysteine rich. Suitable cysteine rich monomer domains include, e.g., the LDL receptor class A domain ("A-domain") or the EGF domain. The monomer domains can also have a cluster of negatively charged residues.

Other features of monomer domains can include the ability to bind ligands or the ability to bind an ion (e.g., $Ca^{2+}$ binding by the LDL receptor A-domain). Monomer domains that bind ions to maintain their secondary structure include, e.g., A domain, EGF domain, EF Hand (e.g., such as those found in present in calmodulin and troponin C), Cadherin domain, C-type lectin, C2 domain, Annexin, Gla-domain, Trombospondin type 3 domain, all of which bind calcium, and zinc fingers (e.g., C2H2 type C3HC4 type (RING finger), Integrase Zinc binding domain, PHD finger, GATA zinc finger, FYVE zinc finger, B-box zinc finger), which bind zinc. Without intending to limit the invention, it is believed that ion-binding provides stability of secondary structure while providing sufficient flexibility to allow for numerous binding conformations depending on primary sequence.

As described herein, monomer domains may be selected for the ability to bind to targets other than the target that a homologous naturally occurring domain may bind. Thus, in some embodiments, the invention provides monomer domains (and multimers comprising such monomers) that do not bind to the target or the class or family of target proteins that a substantially identical naturally occurring domain may bind.

Characteristics of a monomer domain can include the ability to fold independently and the ability to form a stable structure. Thus, the structure of the monomer domain is often conserved, although the polynucleotide sequence encoding the monomer need not be conserved. For example, the A-domain structure is conserved among the members of the A-domain family, while the A-domain nucleic acid sequence is not. Thus, for example, a monomer domain is classified as an A-domain by its cysteine residues and its affinity for calcium, not necessarily by its nucleic acid sequence. See, FIGS. 1 and 2.

Specifically, the A-domains (sometimes called "complement-type repeats" or "LDL receptor type or class A domains") contain about 30-50 or 30-65 amino acids. In some embodiments, the domains comprise about 35-45 amino acids and in some cases about 35-40 amino acids. Within the 30-50 amino acids, there are about 6 cysteine residues. Of the six cysteines, disulfide bonds typically are found between the following cysteines: C1 and C3, C2 and C5, C4 and C6. The cysteine residues of the domain are disulfide linked to form a compact, stable, functionally independent moiety. See, FIG. 3. Clusters of these repeats make up a ligand binding domain, and differential clustering can impart specificity with respect to the ligand binding.

Exemplary A domain sequences and consensus sequences are depicted in FIGS. 1 and 2. One typical consensus sequence useful to identify A domains is the following:

(SEQ ID NO: 340)
C-[VILMA]-$X_{(5)}$-C-[DNH]-$X_{(3)}$-[DENQHT]-C-$X_{(3,4)}$-[STADE]-[DEH]-[DE]-$X_{(1,5)}$-C, where the residues in brackets indicate possible residues at one position. "$X_{(\#)}$" indicates number of residues. These residues can be any amino acid residue. Parentheticals containing two numbers refers to the range of amino acids that can occupy that position (e.g., "[DE]-$X_{(1,5)}$-C" means that the amino acids DE are followed by 1, 2, 3, 4, or 5 residues, followed by C). This consensus sequence only represents the portion of the A domain beginning at the third cysteine. A second consensus is as follows:

(SEQ ID NO: 341)
C-$X_{(3-15)}$-C-$X_{(4-15)}$-C-$X_{(6-7)}$-C-[N, D]-$X_{(3)}$-[D, E, N, Q, H, S, T]-C-$X_{(4-6)}$-D-E-$X_{(2-8)}$-C.

The second consensus predicts amino acid residues spanning all six cysteine residues. In some embodiments, A domain variants comprise sequences substantially identical to any of the above-described sequences. Note that reference to "LDL receptor class A" domain, for the purposes of this invention, is not intended to indicate origin or binding properties of the domain.

Additional exemplary A domains include the following sequence:

(SEQ ID NO: 342)
$C_a X_{3-15} C_b X_{3-15} C_c X_{6-7} C_d$(D, N)$X_4 C_e X_{4-6}$DE$X_{2-8} C_f$ wherein C is cysteine, $X_{n-m}$ represents between n and m number of independently selected amino acids, and (D,N) indicates that the position can be either D or N; and wherein $C_a$—$C_c$, $C_b$—$C_e$ and $C_d$—$C_f$ form disulfide bonds.

To date, at least 190 naturally occurring human A-domains are identified based on cDNA sequences. See, e.g., FIG. 6. Exemplary proteins containing naturally occurring A-domains include, e.g., complement components (e.g., C6, C7, C8, C9, and Factor 1), serine proteases (e.g., enteropeptidase, matriptase, and corin), transmembrane proteins (e.g., ST7, LRP3, LRP5 and LRP6) and endocytic receptors (e.g., Sortilin-related receptor, LDL-receptor, VLDLR, LRP1, LRP2, and ApoER2). A domains and A domain variants can be readily employed in the practice of the present invention as monomer domains and variants thereof. Further description of A domains can be found in the following publications and references cited therein: Howell and Hertz, *The LDL receptor gene family: signaling functions during development*, (2001) *Current Opinion in Neurobiology* 11:74-81; Herz (2001), supra; Krieger, *The "best" of cholesterols, the "worst" of cholesterols: A tale of two receptors*, (1998) *PNAS* 95: 4077-4080; Goldstein and Brown, *The Cholesterol Quartet*, (2001) *Science*, 292: 1310-1312; and, Moestrup and Verroust, *Megalin- and Cubilin-Mediated Endocytosis of Protein-Bound Vitamins, Lipids, and Hormones in Polarized Epithelia*, (2001) *Ann. Rev. Nutr.* 21:407-28.

A number of other domain types can also be used to generate IL-6-binding monomer domains.

Exemplary EGF monomer domains include the sequence:

(SEQ ID NO: 343)
$C_a X_{3-14} C_b X_{3-7} C_c X_{4-16} C_d X_{1-2} C_e X_{8-23} C_f$ wherein C is cysteine, $X_{n-m}$ represents between n and m number of independently selected amino acids; and wherein $C_a$—$C_c$, $C_b$—$C_e$ and $C_d$—$C_f$ form disulfide bonds.

Each of the domains described below employ exemplary motifs (i.e., scaffolds). Certain positions are marked x, indicating that any amino acid can occupy the position. These positions can include a number of different amino acid possibilities, thereby allowing for sequence diversity and thus affinity for different target molecules. Use of brackets in motifs indicates alternate possible amino acids within a position (e.g., "[ekq]" indicates that either E, K or Q may be at that position). As used herein, use of parentheses in a sequence motif indicates that that the positions within the parentheses may be present or absent (e.g., "([ekq])" indicates that the position is absent or either E, K, or Q may be at that position). When more than one "x" is used in parentheses (e.g., "(xx)"), each x represents a possible position. Thus "(xx)" indicates that zero, one or two amino acids may be at that position(s), where each amino acid is independently selected from any amino acid. α represents an aromatic/hydrophobic amino acid such as, e.g., W, Y, F, or L; β represents a hydrophobic amino acid such as, e.g., V, I, L, A, M, or F; χ represents a smaller polar amino acid such as, e.g., G, A, S, or T; δ represents a charged amino acid such as, e.g., K, R, E, Q, or D; represents a small amino acid such as, e.g.; V, A, S, or T; and φ represents a negatively charged amino acid such as, e.g., D, E, or N.

Suitable domains include, e.g. thrombospondin type 1 domains, trefoil domains, and thyroglobulin domains.

Thrombospondin type 1 ("TSP1") domains contain about 30-50 or 30-65 amino acids. In some embodiments, the domains comprise about 35-55 amino acids and in some cases about 50 amino acids. Within the 35-55 amino acids, there are typically about 4 to about 6 cysteine residues. Of the six cysteines, disulfide bonds typically are found between the following cysteines: C1 and C5, C2 and C6, C3 and C4. The cysteine residues of the domain are disulfide linked to form a compact, stable, functionally independent moiety comprising distorted beta strands. Clusters of these repeats make up a ligand binding domain, and differential clustering can impart specificity with respect to the ligand binding.

Exemplary TSP1 domain sequences and consensus sequences are as follows (SEQ ID NOS:344-349):

(1) (xxxxxx)$C_1$xxx$C_2$xxxxx(x)xxxxx$C_3$xxxx(xxx)xxxxx$C_4$
    xxxxxx(x)xxx$C_5$(x)xxxx$C_6$;

(2) (wxxWxx)$C_1$xxx$C_2$xxGxx(x)xRxxx$C_3$xxxx(Pxx)xxxxx$C_4$
    xxxxxx(x)xxx$C_5$(x)xxxx$C_6$;

(3) (wxxWxx)$C_1$sxt$C_2$xxGxx(x)xRxrx$C_3$xxxx(Pxx)xxxxx$C_4$
    xxxxxx(x)xxx$C_5$(x)xxxx$C_6$ (4) (WxxWxx)$C_1$[Stnd][Vkaq][Tspl]$C_2$xx[Gq]xx(x)x[Re]
    x[Rktvm]x[$C_3$vldr]xxxx([Pq]xx)xxxxx[$C_4$ldae]
    xxxxxx(x)xxx$C_5$(x)xxxx$C_6$;

(5) (WxxWxx)$C_1$[Stnd][Vkaq][Tspl]$C_2$xx[Gq]xx(x)x[Re]
    x[Rktvm]x[$C_3$vldr]xxxx([Pq]xx)xxxxx[$C_4$dae]xxxxxx (x)xxx$C_5$(x)xxxx$C_6$; and (6) $C_1$[nst][aegiklqrstv][adenpqrst]$C_2$[adetgs]xgx
    [ikqrstv]x[aqrst]x[almrtv]x$C_3$xxxxxxxxxx(xxxxxxx)
    $C_4$xxxxxxxxxx(xx)$C_5$xxxx$C_6$ In some embodiments, thrombospondin type 1 domain variants comprise sequences substantially identical to any of the above-described sequences.

To date, at least 1677 naturally occurring thrombospondin domains have identified based on cDNA sequences. Exemplary proteins containing the naturally occurring thrombospondin domains include, e.g., proteins in the complement pathway (e.g., properdin, C6, C7, C8A, C8B, and C9), extracellular matrix proteins (e.g., mindin, F-spondin, SCO-spondin), circumsporozoite surface protein 2, and TRAP proteins of *Plasmodium*. Thrombospondin type 1 domains are further described in, e.g., Roszmusz et al., *BBRC* 296:156 (2002); Higgins et al., *J Immunol.* 155:5777-85 (1995); Schultz-Cherry et al., *J. Biol. Chem.* 270:7304-7310 (1995); Schultz-Cherry et al., *J. Biol. Chem.* 269:26783-8 (1994); Bork, *FEBS Lett* 327:125-30 (1993); and Leung-Hagesteijn et al., *Cell* 71:289-99 (1992).

Another exemplary monomer domain suitable for use in the practice of the present invention is the trefoil domain. Trefoil monomer domains are typically about 30-50 or 30-65 amino acids. In some embodiments, the domains comprise about 35-55 amino acids and in some cases about 45 amino acids. Within the 35-55 amino acids, there are typically about 6 cysteine residues. Of the six cysteines, disulfide bonds typically are found between the following cysteines: C1 and C5, C2 and C4, C3 and C6.

To date, at least 149 naturally occurring trefoil domains have identified based on cDNA sequences. Exemplary proteins containing naturally occurring trefoil domains include, e.g., protein pS2 (TFF1), spasmolytic peptide SP (TFF2), intestinal trefoil factor (TFF3), intestinal surcease-isomaltase, and proteins which may be involved in defense against microbial infections by protecting the epithelia (e.g., *Xenopus* xP1, xP4, integumentary mucins A.1 and C.1. Trefoil domains are further described in, e.g., Sands and Podolsky, *Annu. Rev. Physiol.* 58:253-273 (1996); Carr et al., *PNAS USA* 91:2206-2210 (1994); DeA et al., *PNAS USA* 91:1084-1088 (1994); Hoffman et al., *Trends Biochem Sci* 18:239-243 (1993).

Exemplary trefoil domain sequences and consensus sequences are as follows (SEQ ID NOS:350-355):

(1) $C_1$(xx)xxxxxxxxxx$C_2$xx(x)xxxxxxx$C_3$xxxx$C_4$$C_5$xxxxx(x)xxxxx$C_6$ (2) $C_1$(xx)xxxxxxRxx$C_2$xx(x)xxxxxxx$C_3$xxxx$C_4$$C_5$xxxxx(x)xxxxx$C_6$ (3) $C_1$(xx)xxxpxxRxn$C_2$gx(x)pxitxxx$C_3$xxxg$C_4$$C_5$fdxxx(x)xxxpw$C_6$f (4) $C_1$(xx)xxx[Pvae]xxRx[ndpm]$C_2$[Gaiy][ypfst]([de]x)[pskq]x[Ivap][Tsa]xx[qedk]$C_3$xx
    [krln][Gnk]$C_4$$C_5$[Fwy][Dnrs][sdpnte]xx(x)xxx[pki][Weash]$C_6$[Fy]

(5) $C_1$(xx)xxx[Pvae]xxRx[ndpm]$C_2$[Gaiy][ypfst]([de]x)[pskq]x[Ivap][Tsa]xx[keqd]$C_3$xx
    [krln][Gnk]$C_4$$C_5$[α][Dnrs][sdpnte]xx(x)xxx[pki][Weash]$C_4$[Fy]

-continued (6) $C_1$([dnps])[adiklnprstv][dfilmv][adenprst][adelprv][ehklnqrs][adegknsv][kqr]
    [fiklqrtv][dnpqs]$C_2$[agiy][flpsvy][dknpqs][adfghlp][aipv][st][aegkpqrs][adegkpqs][deiknqt]
    $C_3$[adefknqrt][adegknqs][gn]$C_4C_5$[wyfh][deinrs][adgnpst][aefgqlrstw][giknsvmq]([fmprstv][degklns][afiqstv][iknpv]w)$C_6$ Another exemplary monomer domain suitable for use in the present invention is the thyroglobulin domain. Thyroglobulin monomer domains are typically about 30-85 or 30-80 amino acids. In some embodiments, the domains comprise about 35-75 amino acids and in some cases about 65 amino acids. Within the 35-75 amino acids, there are typically about 6 cysteine residues. Of the six cysteines, disulfide bonds typically are found between the following cysteines: C1 and C2, C3 and C4, C5 and C6.

To date at least 251 naturally occurring thyroglobulin domains have been identified based on cDNA sequences. The N-terminal section of Tg contains 10 repeats of a domain of about 65 amino acids which is known as the Tg type-1 repeat PUBMED:3595599, PUBMED:8797845. Exemplary proteins containing naturally occurring thyroglobulin domains include e.g., the HLA class II associated invariant chain, human pancreatic carcinoma marker proteins, nidogen (entactin), insulin-like growth factor binding proteins (IGFBP), saxiphilin, chum salmon egg cysteine proteinase inhibitor, and equistatin. The Thyr-1 and related domains belong to MEROPS proteinase inhibitor family 131, clan IX. Thyroglobulin domains are further described in, e.g., Molina et al., *Eur. J. Biochem.* 240:125-133 (1996); Guncar et al., *EMBO J* 18:793-803 (1999); Chong and Speicher, *DW* 276:5804-5813 (2001).

Exemplary thyroglobulin domain sequences and consensus sequences are as follows (SEQ ID NOS:356-360):

(1) $C_1$xxxxxxxxxxxxxxx(xxxxxxxxxx)xxxxxxxxxxx$C_2$xxxxxxxxxx$C_3$x(x)x(xxx)xxxx$C_4$x$C_5$xxxx(x)xxxxxxxxxxxxxx(xx)x$C_6$ (2) $C_1$xxxxxxxxxxxxxxx(xxxxxxxxxx)xxxxxxxyxPx$C_2$xxxGxxxxxQ$C_3$x(x)x(xxx)xxxx$C_4$W$C_5$Vxxx(x)GxxxxGxxxxxxxx(xx)x$C_6$ (3) $C_1$xxxxxxxxxxxxxxx(xxxxxxxxxx)xxxxxxxyxPx$C_2$xxxGxyxxxQ$C_3$x(x)s(xxx)xxgx$C_4$W$C_5$Vdxx(x)GxxxxGxxxxxgxx(xx)x$C_6$ (4) $C_1$[qerlxxxxxxxxxxxxxx(xxxxxxxxxx)xxxxxxx[Yfhp]xPx$C_2$xxxGx[Yf]xx[vkrl]Q$C_3$x(x[sa]xxx)xx[Gsa]x$C_4$[Wyf]$C_5$V[Dnyfl]xx(x)Gxxxx[Gdne]xxxxxgxx(xx)x$C_6$ (5) $C_1$[qerl]xxxxxxxxxxxxxx(xxxxxxxxxx)xxxxxxx[αhp]xPxC2xxxGx[α]xx[vkrl]Q$C_3$x(x[sa]xxx)xx[gas]x$C_4$[α]$C_5$V[Dnα]xx(x)Gxxxx[ϕg]xxxxxgxx(xx)x$C_6$ Another exemplary monomer domain that can be used in the present invention is a laminin-EGF domain. Laminin-EGF domains are typically about 30-85 or 30-80 amino acids. In some embodiments, the domains comprise about 45-65 amino acids and in some cases about 50 amino acids. Within the 45-65 amino acids, there are typically about 8 cysteine residues which interact to form 4 disulfide bonds. Laminins are a major noncollagenous component of basement membranes that mediate cell adhesion, growth migration, and differentiation. They are composed of distinct but related alpha, beta, and gamma chains. The three chains form a cross-shaped molecule that consist of a long arm and three short globular arms. The long arm consists of a coiled coil structure contributed by all three chains and cross-linked by interchain disulfide bonds.

Exemplary laminin EGF domain sequences and consensus sequences are as follows (SEQ ID NOS:361-363):

(1) $C_1$x$C_2$xxxxxx(xxx)xx$C_3$xxx(xxxxxx)xxxx$C_4$x$C_5$xxxxxxxx$C_6$xx$C_7$xxxxxxx(xxxxx)xxxxx$C_8$ (2) $C_1$x$C_2$xxxxxx(xxx)xxC3xxx(xxxxxx)xxgx$C_4$x$C_5$xxxxxGxx$C_6$xx$C_7$xxxxxxx(xxxxx)xxxxx$C_8$ (3) $C_1$x$C_2$[ndh]xxxxx(xxx)xx$C_3$xxx(xxxxxx)xxgx$C_4$x$C_5$xxxxxGxx$C_6$[denq]x$C_7$xx[gn][yfht]xxx(xxxxx)xxxxx$C_8$ In some embodiments, the monomer domain is a Notch/LNR monomer domain, a DSL monomer domain, an Anato monomer domain, an integrin beta monomer domain, and a Ca-EGF monomer domain.

In some embodiments, the Ca-EGF monomer domain comprises the following sequence (SEQ ID NO:364):

DxdE$C_1$xx(xx)xxxx$C_2$x(xx)xxxxx$C_3$xNxxGxfx$C_4$x(xxx)x$C_5$xxgxxxxxxx(xxxxx)xxx$C_6$.

In some embodiments, the Notch/LNR monomer domain, comprises the following sequence (SEQ ID NO:365):

$C_1$xx(xx)xxx$C_2$xxxxxnGx$C_3$xxx$C_4$nxxx$C_5$xxDGxD$C_6$

In some embodiments, the DSL monomer domain comprises the following sequence:

$C_1xxxYygxxC_2xxfC_3xxxxdxxxhxxC_4xxxGxxxC_5xxGWxGxxC_6$. (SEQ ID NO: 366)

Anato monomer domain comprises the following sequence $C_1C_2xdgxxxxx(x)xxxxC_3exrxxxxxx(xx)xxC_4xxxfxxC_5C_6$. (SEQ ID NO: 367)

$D[\beta][Dn]EC_1xx(xx)xxxxxC_2[pdg](dx)xxxxxxC_3xNxxG[sgt][\alpha]xC_4x(xxx)xC_5xx[Gsn][\alpha s]$ (SEQ ID NO: 369)
$xxxxxx(xxxxx)xxxC_6$.

$C_1xx(x[\beta\alpha])xxxC_2x[\phi s]xxx[\phi][Gk]xC_3[nd]x[\phi sa]C_4[\phi s]xx[aeg]C_5x[\alpha]DGxDC_6$. (SEQ ID NO: 370)

$C_1xxx[\alpha][\alpha h][Gsna]xxC_2xx[\alpha]C_3x[pae]xx[Da]xx[\chi 1][Hrgk][\alpha k]xC_4[dnsg]xxGxxxC_5xxG[\alpha]xG$ (SEQ ID NO: 371)
$xxC_6$.

$C_1C_2x[Dhtl][Ga]xxxx[plant](xx)xxxxC_3[esqdat]x[Rlps]xxxxxx([gepa]x)xxC_4xx[avfpt]$ (SEQ ID NO: 372)
$[Fqvy]xxC_5C_6$.

In some embodiments, the integrin beta monomer domain comprises the following sequence (SEQ ID NO:368):

$C_1xxC_2xxxxpxC_3xwC_4xxxxfxxx(gx)xxxxRC_5dxxxxLxxxgC_6$;

and "x" is any amino acid.

In some embodiments, $C_1$—$C_5$, $C_2$—$C_4$ and $C_3$—$C_6$ of the Notch/LNR monomer domain form disulfide bonds; and $C_1$—$C_5$, $C_2$—$C_4$ and $C_3$—$C_6$ of the DSL monomer domain form disulfide bonds.

In some embodiments, the Ca-EGF monomer domain comprises the following sequence:

In some embodiments, the Notch/LNR monomer domain, comprises the following sequence:

In some embodiments, the DSL monomer domain comprises the following sequence:

In some embodiments, the Anato monomer domain comprises the following sequence:

In some embodiments, the integrin beta monomer domain comprises the following sequence:

$C_1xxC_2[\beta]xx[ghds][Pk]xC_3[\chi][\alpha]C_4xxxx[\alpha]xxx([Gr]xx)$ (SEQ ID NO: 373)
$x[\chi]xRC_5[Dnae]xxxxL[\beta k]xx[Gn]C_6$;

α is selected from: w, y, f, and l; β is selected from: v, i, l, a, m, and f; χ is selected from: g, a, s, and t; δ is selected from: k, r, e, q, and d; ε is selected from: v, a, s, and t; and φ is selected from: d, e, and n.

In some embodiments, the Ca-EGF monomer domain comprises the following sequence:

$D[vilf][Dn]EC_1xx(xx)xxxxC_2[dg](dx)xxxxxC_3xNxxG[sgt][fy]xC_4x(xxx)xC_5xx[Gsn]$ (SEQ ID NO: 374)
$[\alpha s]xxxxxx(xxxxx)xxxC_6$.

In some embodiments, the Notch/LNR monomer domain, comprises the following sequence:

$C_1$xx(x[yiflv])xxx$C_2$x[dens]xxx[Nde][Gk]x$C_3$[nd]x[densa]$C_4$[Nsde]xx[aeg]$C_5$x[wyf]DGxD$C_6$. (SEQ ID NO: 375)

In some embodiments, the DSL monomer domain comprises the following sequence:

$C_1$xxx[Ywf][Yfh][Gasn]xx$C_2$xx[Fy]$C_3$x[pae]xx[Da]xx[glast][Hrgk][ykfw]x$C_4$[dsgn]xxGxxx$C_5$x xG[Wlfy]xGxx$C_6$. (SEQ ID NO: 376)

In some embodiments, the Anato monomer domain comprises the following sequence:

$C_1$$C_2$x[adehlt]gxxxxxxxx(x)[derst]$C_3$xxxxxxxxx(xx[aersv])$C_4$xx[apvt][fmq][eklqrtv] [adehqrsk](x)$C_5$$C_6$. (SEQ ID NO: 377)

In some embodiments, the integrin beta monomer domain comprises the following sequence:

$C_1$[aegkqrst][kreqd]$C_2$[il][aelqrv][vilas][dghs][kp]x$C_3$[gast][wy]$C_4$xxxx[fl]xxxx(xxxx [vilar]r)$C_5$[and][dilrt][iklpqrv][adeps][aenq]l[iklqv]x[adknr][gn]$C_6$. (SEQ ID NO: 378)

Polynucleotides encoding the monomer domains are typically employed to make monomer domains via expression. Nucleic acids that encode monomer domains can be derived from a variety of different sources. Libraries of monomer domains can be prepared by expressing a plurality of different nucleic acids encoding naturally occurring monomer domains, altered monomer domains (i.e., monomer domain variants), or a combinations thereof. For example, libraries may be designed in which a scaffold of amino acids remain constant (e.g., an LDL receptor A-domain, EGF domain) while the intervening amino acids in the scaffold comprise randomly generated amino acids.

Figure 4:
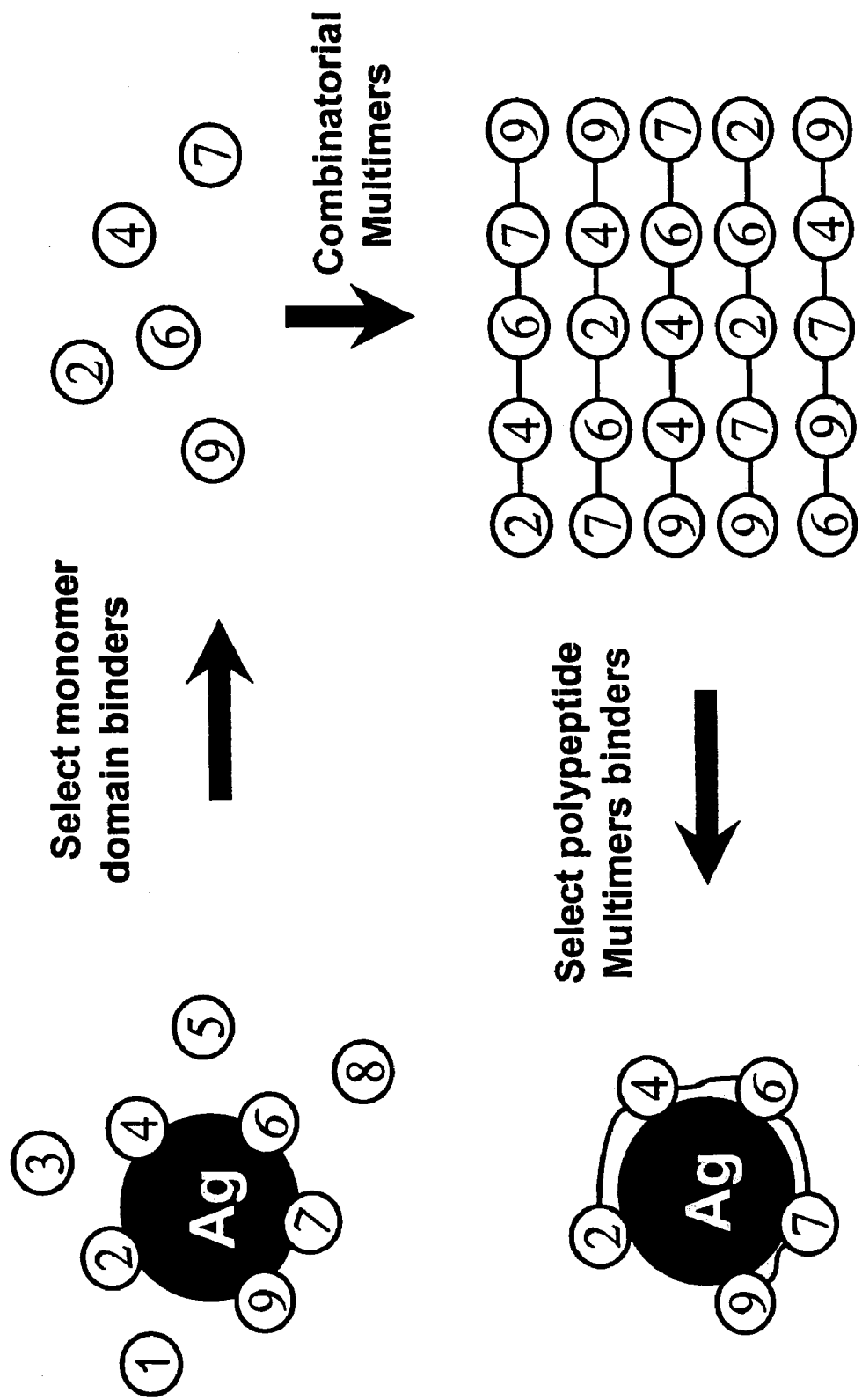
FIG. 4 schematically illustrates a general scheme for identifying monomer domains that bind to a ligand, isolating the selected monomer domains, creating multimers of the selected monomer domains by joining the selected monomer domains in various combinations and screening the multimers to identify multimers comprising more than one monomer that binds to a ligand.

The invention provides methods of identifying monomer domains that bind to a selected or desired ligand or mixture of ligands. In some embodiments, monomer domains are identified or selected for a desired property (e.g., binding affinity) and then the monomer domains are formed into multimers. See, e.g., FIG. 4. For those embodiments, any method resulting in selection of domains with a desired property (e.g., a specific binding property) can be used. For example, the methods can comprise providing a plurality of different nucleic acids, each nucleic acid encoding a monomer domain; translating the plurality of different nucleic acids, thereby providing a plurality of different monomer domains; screening the plurality of different monomer domains for binding of the desired ligand or a mixture of ligands; and, identifying members of the plurality of different monomer domains that bind the desired ligand or mixture of ligands.

Monomer domains can be naturally occurring or altered (non-natural variants). The term "naturally occurring" is used herein to indicate that an object can be found in nature. For example, natural monomer domains can include human monomer domains or optionally, domains derived from different species or sources, e.g., mammals, primates, rodents, fish, birds, reptiles, plants, etc. The natural occurring monomer domains can be obtained by a number of methods, e.g., by PCR amplification of genomic DNA or cDNA.

Monomer domains of the present invention can be naturally occurring domains or non-naturally occurring variants. Libraries of monomer domains employed in the practice of the present invention may contain naturally occurring monomer domains, non-naturally occurring monomer domain variants, or a combination thereof.

Monomer domain variants can include ancestral domains, chimeric domains, randomized domains, mutated domains, and the like. For example, ancestral domains can be based on phylogenetic analysis. Chimeric domains are domains in which one or more regions are replaced by corresponding regions from other domains of the same family. For example, chimeric domains can be constructed by combining loop sequences from multiple related domains of the same family to form novel domains with potentially lowered immunogenicity. Those of skill in the art will recognized the immunologic benefit of constructing modified binding domain monomers by combining loop regions from various related domains of the same family rather than creating random amino acid sequences. For example, by constructing variant domains by combining loop sequences or even multiple loop sequences that occur naturally in human LDL receptor class A-domains, the resulting domains may contain novel binding properties but may not contain any immunogenic protein sequences because all of the exposed loops are of human origin. The combining of loop amino acid sequences in endogenous context can be applied to all of the monomer constructs of the invention. Thus the present invention provides a method for generating a library of chimeric monomer domains derived from human proteins, the method comprising: providing loop sequences corresponding to at least one loop from each of at least two different naturally occurring variants of a human protein, wherein the loop sequences are polynucleotide or polypeptide sequences; and covalently combining loop sequences to generate a library of at least two different chimeric sequences, wherein each chimeric sequence encodes a chimeric monomer domain having at least two loops. Typically, the chimeric domain has at least four loops, and usually at least six loops. As described above, the present invention provides three types of loops that are identified by specific features, such as, potential for disulfide bonding, bridging between secondary protein structures, and molecular dynamics (i.e., flexibility). The three types of loop sequences are a cysteine-defined loop sequence, a structure-defined loop sequence, and a B-factor-defined loop sequence.

Randomized domains are domains in which one or more regions are randomized. The randomization can be based on full randomization, or optionally, partial randomization based on natural distribution of sequence diversity.

The present invention also provides recombinant nucleic acids encoding one or more polypeptides comprising one or a plurality of monomer domains that bind IL-6. For example, the polypeptide can be selected to comprise a non-naturally occurring domain from the group consisting of: an EGF-like domain, a Kringle-domain, a fibronectin type I domain, a fibronectin type II domain, a fibronectin type II domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain and variants of one or more thereof. In another embodiment, the naturally occurring polypeptide encodes a monomer domain found in the Pfam database and/or the SMART database.

All the compositions of the present invention, including the compositions produced by the methods of the present invention, e.g., monomer domains and/or immuno-domains, as well as multimers and libraries thereof can be optionally bound to a matrix of an affinity material. Examples of affinity material include beads, a column, a solid support, a microarray, other pools of reagent-supports, and the like.

III. Multimers

Methods for generating multimers are a feature of the present invention. Multimers comprise at least two monomer domains. For example, multimers of the invention can comprise from 2 to about 10 monomer domains, from 2 and about 8 monomer domains, from about 3 and about 10 monomer domains, about 7 monomer domains, about 6 monomer domains, about 5 monomer domains, or about 4 monomer domains. In some embodiments, the multimer comprises 3 or at least 3 monomer domains. In some embodiments, the multimers have no more than 2, 3, 4, 5, 6, 7, or 8 monomer domains. In view of the possible range of monomer domain sizes, the multimers of the invention may be, e.g., less than 100 kD, less than 90 kD, less than 80 kD, less than 70 kD, less than 60 kD, less than 50 kd, less than 40 kD, less than 30 kD, less than 25 kD, less than 20 kD, less than 15 kD, less than 10 kD or may be smaller or larger. In some cases, the monomer domains have been pre-selected for binding to the target molecule of interest (e.g., IL-6). In some embodiments, the multimers of the invention will bind to IL-6 (or, e.g., a blood factor such as HSA or IgG) with an affinity of less than $10^{-3}$ M (i.e., binds stronger than an affinity of $10^{-3}$ M). In some embodiments, the affinity is less than $10^{-4}$ M, $10^{-5}$ M, $10^{-6}$ M, $10^{-7}$ M, $10^{-8}$ M, $10^{-9}$ M, or $10^{-10}$ M. In some embodiments, the affinity of a multimer will be stronger (less) than the sum of affinities of the respective monomer domains in the multimer.

In some embodiments, each monomer domain specifically binds to one target molecule (e.g., IL-6). In some of these embodiments, each monomer binds to a different position (analogous to an epitope) on a target molecule. Multiple monomer domains that bind to the same target molecule results in an avidity effect resulting in improved affinity of the multimer for the target molecule compared to the affinity of each individual monomer. In some embodiments, the multimer has an avidity of at least about 1.5, 2, 3, 4, 5, 10, 20, 50, 100, 200, 500, or 1000 times the avidity of a monomer domain alone. In some embodiments, at least one, two, three, four or more (e.g., all) monomers of a multimer bind an ion such as calcium or another ion. Multimers can comprise a variety of combinations of monomer domains. For example, in a single multimer, the selected monomer domains can be identical or different. In addition, the selected monomer domains can comprise various different monomer domains from the same monomer domain family, or various monomer domains from different domain families, or optionally, a combination of both. For example, the monomer domains may be selected from Families 1-7 of IL-6-binding monomer domains. In some embodiments, at least one of the monomer domains is selected from Family 3 and/or 5 of the IL-6 binding monomer domains. Exemplary IL-6-binding dimers and trimers (comprised of two or three, respectively, IL-6-binding monomers) are listed in the examples.

Multimers that are generated in the practice of the present invention may be any of the following:

(1) A homo-multimer (a multimer of the same domain, i.e., A1-A1-A1-A1);

(2) A hetero-multimer of different domains of the same domain class, e.g., A1-A2-A3-A4. For example, hetero-multimer include multimers where some of A1, A2, A3 and A4 are different non-naturally occurring variants of a particular LDL-receptor class A domains, or where some of A1, A2, A3, and A4 are naturally occurring variants of a LDL-receptor class A domain.

(3) A hetero-multimer of domains from different monomer domain classes, e.g., A1-B2-A2-B1. For example, where A1 and A2 are two different monomer domains (either naturally occurring or non-naturally occurring) from LDL-receptor class A, and B1 and B2 are two different monomer domains (either naturally occurring or non-naturally occurring) from class EGF-like domain).

In another embodiment, the multimer comprises monomer domains with specificities for different target molecules (e.g., a blood factor such as serum albumin, immunoglobulin, or erythrocytes). For example, in some embodiments, the multimers of the invention comprises 1, 2, 3, or more monomer domains that bind to IL-6 and at least one monomer domain that binds to a second target molecule. Exemplary target molecules include, e.g., a serum molecule that extends the serum half-life of the multimer (e.g., an immunoglobulin or serum albumin). Exemplary molecules that extend the serum half-life of a multimer include, e.g., red blood cells (i.e., erythrocytes), IgG, and serum albumin such as HSA. An exemplary multimer may include, e.g., a monomer domain from Family 3 and/or Family 5 of the IL-6 binding monomer domains (and optionally 2, 3, 4, or more IL-6 binding domains) and one or more immunoglobulin binding monomer domains, e.g., monomer domain(s) from Family 2 or 3 of the immunoglobulin binding monomer domains.

Multimer libraries employed in the practice of the present invention may contain homo-multimers, hetero-multimers of different monomer domains (natural or non-natural) of the same monomer class, or hetero-multimers of monomer domains (natural or non-natural) from different monomer classes, or combinations thereof.

Monomer domains, as described herein, are also readily employed in a immuno-domain-containing heteromultimer (i.e., a multimer that has at least one immuno-domain variant and at least one monomer domain variant). Thus, multimers of the present invention may have at least one immuno-domain such as a minibody, a single-domain antibody, a single chain variable fragment (ScFv), or a Fab fragment; and at least one monomer domain, such as, for example, an EGF-like domain, a Kringle-domain, a fibronectin type I domain, a fibronectin type II domain, a fibronectin type III domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain, or variants thereof.

Domains need not be selected before the domains are linked to form multimers. On the other hand, the domains can be selected for the ability to bind to a target molecule before being linked into multimers. Thus, for example, a multimer can comprise two domains that bind to one target molecule and a third domain that binds to a second target molecule.

The multimers of the present invention may have the following qualities: multivalent, multispecific, single chain, heat stable, extended serum and/or shelf half-life. Moreover, at least one, more than one or all of the monomer domains may bind an ion (e.g., a metal ion or a calcium ion), at least one, more than one or all monomer domains may be derived from LDL receptor A domains and/or EGF-like domains, at least one, more than one or all of the monomer domains may be non-naturally occurring, and/or at least one, more than one or all of the monomer domains may comprise 1, 2, 3, or 4 disulfide bonds per monomer domain. In some embodiments, the multimers comprise at least two (or at least three) monomer domains, wherein at least one monomer domain is a non-naturally occurring monomer domain and the monomer domains bind calcium. In some embodiments, the multimers comprise at least 4 monomer domains, wherein at least one monomer domain is non-naturally occurring, and wherein:

a. each monomer domain is between 30-100 amino acids and each of the monomer domains comprise at least one disulfide linkage; or b. each monomer domain is between 30-100 amino acids and is derived from an extracellular protein; or c. each monomer domain is between 30-100 amino acids and binds to a protein target.

In some embodiments, the multimers comprise at least 4 monomer domains, wherein at least one monomer domain is non-naturally occurring, and wherein:

a. each monomer domain is between 35-100 amino acids; or b. each domain comprises at least one disulfide bond and is derived from a human protein and/or an extracellular protein.

In some embodiments, the multimers comprise at least two monomer domains, wherein at least one monomer domain is non-naturally occurring, and wherein each domain is:

a. 25-50 amino acids long and comprises at least one disulfide bond; or b. 25-50 amino acids long and is derived from an extracellular protein; or c. 25-50 amino acids and binds to a protein target; or d. 35-50 amino acids long.

In some embodiments, the multimers comprise at least two monomer domains, wherein at least one monomer domain is non-naturally occurring and:

a. each monomer domain comprises at least one disulfide bond; or b. at least one monomer domain is derived from an extracellular protein; or c. at least one monomer domain binds to a target protein.

The monomer domains and/or multimers identified can have biological activity, which is meant to include at least specific binding affinity for a selected or desired ligand, and, in some instances, will further include the ability to block the binding of other compounds, to stimulate or inhibit metabolic pathways, to act as a signal or messenger, to stimulate or inhibit cellular activity, and the like. In some embodiments, the monomer domains of the invention bind to IL-6R, the IL-6 receptor. In some embodiments, these monomer domains either block IL-6 binding to IL-6R or activate the IL-6 receptor.

A single ligand can be used, or optionally a variety of ligands can be used to select the monomer domains and/or multimers. A monomer domain of the present invention can bind a single ligand or a variety of ligands. A multimer of the present invention can have multiple discrete binding sites for a single ligand, or optionally, can have multiple binding sites for a variety of ligands.

In some embodiments, the multimers of the invention bind to the same or other multimers to form aggregates. Aggregation can be mediated, for example, by the presence of hydrophobic domains on two monomer domains, resulting in the formation of non-covalent interactions between two monomer domains. Alternatively, aggregation may be facilitated by one or more monomer domains in a multimer having binding specificity for a monomer domain in another multimer. Aggregates can also form due to the presence of affinity peptides on the monomer domains or multimers. Aggregates can contain more target molecule binding domains than a single multimer.

Multimers with affinity for both a cell surface target and a second target (e.g., IL-6) may provide for increased avidity effects. In some cases, membrane fluidity can be more flexible than protein linkers in optimizing (by self-assembly) the spacing and valency of the interactions. In some cases, multimers will bind to two different targets, each on a different cell or one on a cell and another on a molecule with multiple binding sites.

In some embodiments, the monomers or multimers of the present invention are linked to another polypeptide to form a fusion protein. Any polypeptide in the art may be used as a fusion partner, though it can be useful if the fusion partner forms multimers. For example, monomers or multimers of the invention may be fused to the following locations or combinations of locations of an antibody:

1. At the N-terminus of the VH1 and/or VL1 domains, optionally just after the leader peptide and before the domain starts (framework region 1);

2. At the N-terminus of the CH1 or CL1 domain, replacing the VH1 or VL1 domain;

3. At the N-terminus of the heavy chain, optionally after the CH1 domain and before the cysteine residues in the hinge (Fc-fusion);

4. At the N-terminus of the CH3 domain;

5. At the C-terminus of the CH3 domain, optionally attached to the last amino acid residue via a short linker;

6. At the C-terminus of the CH2 domain, replacing the CH3 domain;

7. At the C-terminus of the CL1 or CH1 domain, optionally after the cysteine that forms the interchain disulfide; or 8. At the C-terminus of the VH1 or VL1 domain. See, e.g., FIG. 7.

In some embodiments, one or more monomer or multimer domains of the invention is linked to a molecule (e.g., a protein, nucleic acid, organic small molecule, etc.) useful as a pharmaceutical. Exemplary pharmaceutical proteins include, e.g., cytokines, antibodies, chemokines, growth factors, interleukins (e.g., IL-6), cell-surface proteins, extracellular domains, cell surface receptors, cytotoxins, etc. Exemplary small molecule pharmaceuticals include toxins or therapeutic agents. In some embodiments, a metal can be bound to the polypeptides of the invention. This can be useful, e.g., as a contrast agent, e.g., for MRI.

In some embodiments, the monomer or multimers are selected to bind to a tissue- or disease-specific target protein. Tissue-specific proteins are proteins that are expressed exclusively, or at a significantly higher level, in one or several particular tissue(s) compared to other tissues in an animal.

In some embodiments, the monomers or multimers that bind to the target protein are linked to the pharmaceutical protein or small molecule such that the resulting complex or fusion is targeted to the specific tissue or disease-related cell(s) where the target protein (e.g., IL-6) is expressed. Monomers or multimers for use in such complexes or fusions can be initially selected for binding to the target protein and may be subsequently selected by negative selection against other cells or tissue (e.g., to avoid targeting bone marrow or other tissues that set the lower limit of drug toxicity) where it is desired that binding be reduced or eliminated in other non-target cells or tissues. By keeping the pharmaceutical away from sensitive tissues, the therapeutic window is increased so that a higher dose may be administered safely. In another alternative, in vivo panning can be performed in animals by injecting a library of monomers or multimers into an animal and then isolating the monomers or multimers that bind to a particular tissue or cell of interest.

The fusion proteins described above may also include a linker peptide between the pharmaceutical protein and the monomer or multimers. A peptide linker sequence may be employed to separate, for example, the polypeptide components by a distance sufficient to ensure that each polypeptide folds into its secondary and tertiary structures. Fusion proteins may generally be prepared using standard techniques, including chemical conjugation. Fusion proteins can also be expressed as recombinant proteins in an expression system by standard techniques.

Multimers or monomer domains of the invention can be produced according to any methods known in the art. In some embodiments, E. coli comprising a plasmid encoding the polypeptides under transcriptional control of an inducible promoter are used to express the protein. After harvesting the bacteria, they may be lysed by sonication or homogenization and clarified by centrifugation. The polypeptides may be purified using Ni-NTA agarose elution (if 6xHis (SEQ ID NO:379) tagged) or DEAE sepharose elution (if untagged) and refolded by dialysis. Misfolded proteins may be neutralized by capping free sulfhydrils with iodoacetic acid. Q sepharose elution, butyl sepharose flow-through, SP sepharose elution, DEAE sepharose elution, and/or CM sepharose elution may be used to purify the polypeptides. Equivalent anion and/or cation exchange purification steps may also be employed.

In some embodiments, monomers or multimers are purified using heat lysis, typically followed by a fast cooling to prevent most proteins from renaturing. Due to the heat stability of the proteins of the invention, the desired proteins will not be denatured by the heat and therefore will allow for a purification step resulting in high purity. In some embodiments, a continuous flow heating process to purify the monomers or multimers from bacterial cell cultures is used. For example, a cell suspension can passed through a stainless steel coil submerged in a water bath set to a temperature resulting in lysis of the bacteria (e.g., about 65-100 degrees C.). The lysed effluent is routed to a cooling bath to obtain rapid cooling and prevent renaturation of denatured E. coli proteins. E. coli proteins denature and are prevented from renaturing, but the monomer or multimers do not denature under these conditions due to the exceptional stability of their scaffold. The heating time is controlled by adjusting the flow rate and length of the coil. This approach yields active proteins with high yield and exceptionally high purity (e.g., >80%) compared to alternative approaches and is amenable to large scale production of clinical material.

In some embodiments, following manufacture of the monomers or multimers of the invention, the polypeptides are stored in a solution comprising iodoacetic acid to prevent scrambling of disulfide bind linkages. In some embodiments, 0.1-100 mM (e.g., 1-10 mM) iodoacetic acid is included in the solutions for storage. If desired, the iodoacetic acid can be removed before administered to an individual.

In some embodiments, the polypeptide comprising a monomer or multimer of the invention is linked to itself (C-terminus to N-terminus), e.g., for protein stability.

IV. Linkers

Monomer domains can be joined by a linker to form a multimer. For example, a linker may be positioned between each separate discrete monomer domain in a multimer.

Joining the selected monomer domains via a linker can be accomplished using a variety of techniques known in the art. For example, combinatorial assembly of polynucleotides encoding selected monomer domains can be achieved by restriction digestion and re-ligation, by PCR-based, self-priming overlap reactions, or other recombinant methods. The linker can be attached to a monomer before the monomer is identified for its ability to bind to a target multimer or after the monomer has been selected for the ability to bind to a target multimer.

The linker can be naturally occurring, synthetic or a combination of both. For example, the linker can be a naturally occurring linker for A domains. In another example, the synthetic linker can be a randomized linker, e.g., both in sequence and size. In one aspect, the randomized linker can comprise a fully randomized sequence, or optionally, the randomized linker can be based on natural linker sequences. The linker can comprise, e.g., a non-polypeptide moiety, a polynucleotide, a polypeptide or the like.

A linker can be rigid, or flexible, or a combination of both. Linker flexibility can be a function of the composition of both the linker and the monomer domains that the linker interacts with. The linker joins two selected monomer domain, and maintains the monomer domains as separate discrete monomer domains. The linker can allow the separate discrete monomer domains to cooperate yet maintain separate properties such as multiple separate binding sites for the same ligand in a multimer, or e.g., multiple separate binding sites for different ligands in a multimer.

Choosing a suitable linker for a specific case where two or more monomer domains (i.e. polypeptide chains) are to be connected may depend on a variety of parameters including, e.g. the nature of the monomer domains, the structure and nature of the target to which the polypeptide multimer should bind and/or the stability of the peptide linker towards proteolysis and oxidation.

The present invention provides methods for optimizing the choice of linker once the desired monomer domains/variants have been identified. Generally, libraries of multimers having a composition that is fixed with regard to monomer domain composition, but variable in linker composition and length, can be readily prepared and screened as described above.

A more detailed discussion of linkers can be found in, e.g., U.S. Patent Publication No. 2005/0048512. Exemplary linkers include the following (SEQ ID NOS: 941-943):

```
SAPASEPPGSL

PPRT

AGSVPT
```

V. Identifying Monomers or Multimers with Affinity for a Target Molecule

Those of skill in the art can readily identify monomer domains with a desired property (e.g., binding affinity). For those embodiments, any method resulting in selection of domains with a desired property (e.g., a specific binding property) can be used. For example, the methods can comprise providing a plurality of different nucleic acids, each nucleic acid encoding a monomer domain; translating the plurality of different nucleic acids, thereby providing a plurality of different monomer domains; screening the plurality of different monomer domains for binding of the desired ligand or a mixture of ligands; and, identifying members of the plurality of different monomer domains that bind the desired ligand or mixture of ligands.

In addition, any method of mutagenesis, such as site-directed mutagenesis and random mutagenesis (e.g., chemical mutagenesis) can be used to produce monomer domains, e.g., for a monomer domain library. In some embodiments, error-prone PCR is employed to create variants. Additional methods include aligning a plurality of naturally occurring monomer domains by aligning conserved amino acids in the plurality of naturally occurring monomer domains; and, designing the non-naturally occurring monomer domain by maintaining the conserved amino acids and inserting, deleting or altering amino acids around the conserved amino acids to generate the non-naturally occurring monomer domain. In one embodiment, the conserved amino acids comprise cysteines. In another embodiment, the inserting step uses random amino acids, or optionally, the inserting step uses portions of the naturally occurring monomer domains. The portions could ideally encode loops from domains from the same family. Amino acids are inserted or exchanged using synthetic oligonucleotides, or by shuffling, or by restriction enzyme based recombination. Human chimeric domains of the present invention are useful for therapeutic applications where minimal immunogenicity is desired. The present invention provides methods for generating libraries of human chimeric domains. Human chimeric monomer domain libraries can be constructed by combining loop sequences from different variants of a human monomer domain, as described above. The loop sequences that are combined may be sequence-defined loops, structure-defined loops, B-factor-defined loops, or a combination of any two or more thereof.

Alternatively, a human chimeric domain library can be generated by modifying naturally occurring human monomer domains at the amino acid level, as compared to the loop level. In some embodiments, to minimize the potential for immunogenicity, only those residues that naturally occur in protein sequences from the same family of human monomer domains are utilized to create the chimeric sequences. This can be achieved by providing a sequence alignment of at least two human monomer domains from the same family of monomer domains, identifying amino acid residues in corresponding positions in the human monomer domain sequences that differ between the human monomer domains, generating two or more human chimeric monomer domains, wherein each human chimeric monomer domain sequence consists of amino acid residues that correspond in type and position to residues from two or more human monomer domains from the same family of monomer domains. Libraries of human chimeric monomer domains can be employed to identify human chimeric monomer domains that bind to a target of interest by: screening the library of human chimeric monomer domains for binding to a target molecule, and identifying a human chimeric monomer domain that binds to the target molecule. Suitable naturally occurring human monomer domain sequences employed in the initial sequence alignment step include those corresponding to any of the naturally occurring monomer domains described herein.

Domains of human monomer variant libraries of the present invention (whether generated by varying loops or single amino acid residues) can be prepared by methods known to those having ordinary skill in the art. Methods particularly suitable for generating these libraries are split-pool format and trinucleotide synthesis format as described in WO01/23401.

In some embodiments, monomer domains of the invention are screened for potential immunogenicity by:
providing a candidate protein sequence;
comparing the candidate protein sequence to a database of human protein sequences;
identifying portions of the candidate protein sequence that correspond to portions of human protein sequences from the database; and
determining the extent of correspondence between the candidate protein sequence and the human protein sequences from the database.

In general, the greater the extent of correspondence between the candidate protein sequence and one or more of the human protein sequences from the database, the lower the potential for immunogenicity is predicted as compared to a candidate protein having little correspondence with any of the human protein sequences from the database. A database of human protein sequences that is suitable for use in the practice of the invention method for screening candidate proteins can be found at ncbi.nlm.nih.gov/blast/Blast.cgi at the World Wide Web (in addition, the following web site can be used to search short, nearly exact matches: cbi.nlm.nih.gov/blast/Blast.cgi?CMD=Web&LAYOUT=TwoWindows&AUTO_FORMAT=Semiauto&ALIGNMENTS=50&ALIGNMENT_VIEW=Pairwise&CLIENT=web&DATABASE=nr&DESCRIPTIONS=100&ENTREZ_QUERY=(none)&EXPECT=1000&FORMAT_OBJECT=Alignment&FORMAT_TYPE=HTML&NCBI_GI=on&PAGE=

Nucleotides&PROGRAM=blastn&SERVICE=plain&SET_DEFAULTS.x=29&SET_DEFAULTS.y=6&SHOW_OVERVIEW=on&WORD_SIZE=7&END_OF_HTTPGET=Yes&SHOW_LINKOUT=yes at the World Wide Web). The method is particularly useful in determining whether a crossover sequence in a chimeric protein, such as, for example, a chimeric monomer domain, is likely to cause an immunogenic event. If the crossover sequence corresponds to a portion of a sequence found in the database of human protein sequences, it is believed that the crossover sequence is less likely to cause an immunogenic event.

Information pertaining to portions of human protein sequences from the database can be used to design a protein library of human-like chimeric proteins. Such library can be generated by using information pertaining to "crossover sequences" that exist in naturally occurring human proteins. The term "crossover sequence" refers herein to a sequence that is found in its entirety in at least one naturally occurring human protein, in which portions of the sequence are found in two or more naturally occurring proteins. Thus, recombination of the latter two or more naturally occurring proteins would generate a chimeric protein in which the chimeric portion of the sequence actually corresponds to a sequence found in another naturally occurring protein. The crossover sequence contains a chimeric junction of two consecutive amino acid residue positions in which the first amino acid position is occupied by an amino acid residue identical in type and position found in a first and second naturally occurring human protein sequence, but not a third naturally occurring human protein sequence. The second amino acid position is occupied by an amino acid residue identical in type and position found in a second and third naturally occurring human protein sequence, but not the first naturally occurring human protein sequence. In other words, the "second" naturally occurring human protein sequence corresponds to the naturally occurring human protein in which the crossover sequence appears in its entirety, as described above.

In some embodiments, a library of human-like chimeric proteins is generated by: identifying human protein sequences from a database that correspond to proteins from the same family of proteins; aligning the human protein sequences from the same family of proteins to a reference protein sequence; identifying a set of subsequences derived from different human protein sequences of the same family, wherein each subsequence shares a region of identity with at least one other subsequence derived from a different naturally occurring human protein sequence; identifying a chimeric junction from a first, a second, and a third subsequence, wherein each subsequence is derived from a different naturally occurring human protein sequence, and wherein the chimeric junction comprises two consecutive amino acid residue positions in which the first amino acid position is occupied by an amino acid residue common to the first and second naturally occurring human protein sequence, but not the third naturally occurring human protein sequence, and the second amino acid position is occupied by an amino acid residue common to the second and third naturally occurring human protein sequence, and generating human-like chimeric protein molecules each corresponding in sequence to two or more subsequences from the set of subsequences, and each comprising one of more of the identified chimeric junctions.

Thus, for example, if the first naturally occurring human protein sequence is, A-B-C, and the second is, B-C-D-E, and the third is, D-E-F, then the chimeric junction is C-D. Alternatively, if the first naturally occurring human protein sequence is D-E-F-G, and the second is B-C-D-E-F, and the third is A-B-C-D, then the chimeric junction is D-E. Human-like chimeric protein molecules can be generated in a variety of ways. For example, oligonucleotides comprising sequences encoding the chimeric junctions can be recombined with oligonucleotides corresponding in sequence to two or more subsequences from the above-described set of subsequences to generate a human-like chimeric protein, and libraries thereof. The reference sequence used to align the naturally occurring human proteins is a sequence from the same family of naturally occurring human proteins, or a chimera or other variant of proteins in the family.

Nucleic acids encoding fragments of naturally occurring monomer domains can also be mixed and/or recombined (e.g., by using chemically or enzymatically-produced fragments) to generate full-length, modified monomer domains. The fragments and the monomer domain can also be recombined by manipulating nucleic acids encoding domains or fragments thereof. For example, ligating a nucleic acid construct encoding fragments of the monomer domain can be used to generate an altered monomer domain.

Altered monomer domains can also be generated by providing a collection of synthetic oligonucleotides (e.g., overlapping oligonucleotides) encoding conserved, random, pseudorandom, or a defined sequence of peptide sequences that are then inserted by ligation into a predetermined site in a polynucleotide encoding a monomer domain. Similarly, the sequence diversity of one or more monomer domains can be expanded by mutating the monomer domain(s) with site-directed mutagenesis, random mutation, pseudorandom mutation, defined kernal mutation, codon-based mutation, and the like. The resultant nucleic acid molecules can be propagated in a host for cloning and amplification. In some embodiments, the nucleic acids are shuffled.

The present invention also provides a method for recombining a plurality of nucleic acids encoding monomer domains and screening the resulting library for monomer domains that bind to the desired ligand or mixture of ligands or the like. Selected monomer domain nucleic acids can also be back-crossed by shuffling with polynucleotide sequences encoding neutral sequences (i.e., having insubstantial functional effect on binding), such as for example, by back-crossing with a wild-type or naturally occurring sequence substantially identical to a selected sequence to produce native-like functional monomer domains. Generally, during back-crossing, subsequent selection is applied to retain the property, e.g., binding to the ligand.

In some embodiments, the monomer library is prepared by shuffling. In such a case, monomer domains are isolated and shuffled to combinatorially recombine the nucleic acid sequences that encode the monomer domains (recombination can occur between or within monomer domains, or both). The first step involves identifying a monomer domain having the desired property, e.g., affinity for a certain ligand. While maintaining the conserved amino acids during the recombination, the nucleic acid sequences encoding the monomer domains can be recombined, or recombined and joined into multimers.

A significant advantage of the present invention is that known ligands, or unknown ligands can be used to select the monomer domains and/or multimers. No prior information regarding ligand structure is required to isolate the monomer domains of interest or the multimers of interest. The monomer domains and/or multimers identified can have biological activity, which is meant to include at least specific binding affinity for a selected or desired ligand, and, in some instances, will further include the ability to block the binding of other compounds, to stimulate or inhibit metabolic pathways, to act as a signal or messenger, to stimulate or inhibit cellular activity, and the like. Monomer domains can be generated to function as ligands for receptors where the natural ligand for the receptor has not yet been identified (orphan receptors). These orphan ligands can be created to either block or activate the receptor to which they bind.

A single ligand can be used, or optionally a variety of ligands can be used to select the monomer domains and/or multimers. A monomer domain of the present invention can bind a single ligand or a variety of ligands. A multimer of the present invention can have multiple discrete binding sites for a single ligand, or optionally, can have multiple binding sites for a variety of ligands.

In some embodiments, the multimers or monomers are screened for the ability to bind to a protein from multiple (2, 3, or more) different species. For example, human and primate orthologous proteins can be screened, thereby generating polypeptides that bind the proteins (e.g., IL-6, IgG or other serum half-life extender or other protein) from both a human and a primate, thereby allowing for ease of analysis of toxicology in primates for use in humans.

The invention also includes compositions that are produced by methods of the present invention. For example, the present invention includes monomer domains selected or identified from a library and/or libraries comprising monomer domains produced by the methods of the present invention.

The present invention also provides libraries of monomer domains and libraries of nucleic acids that encode monomer domains. The libraries can include, e.g., about 100, 250, 500 or more nucleic acids encoding monomer domains, or the library can include, e.g., about 100, 250, 500 or more polypeptides that encode monomer domains. Libraries can include monomer domains containing the same cysteine frame, e.g., A-domains or EGF-like domains.

In some embodiments, variants are generated by recombining two or more different sequences from the same family of monomer domains (e.g., the LDL receptor class A domain). Alternatively, two or more different monomer domains from different families can be combined to form a multimer. In some embodiments, the multimers are formed from monomers or monomer variants of at least one of the following family classes: an EGF-like domain, a Kringle-domain, a fibronectin type I domain, a fibronectin type II domain, a fibronectin type III domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, an SH2 domain, an SH3 domain, a Laminin-type EGF-like domain, a C2 domain and variants thereof. In another embodiment, the monomer domain and the different monomer domain can include one or more domains found in the Pfam database and/or the SMART database. Libraries produced by the methods above, one or more cell(s) comprising one or more members of the library, and one or more displays comprising one or more members of the library are also included in the present invention.

Optionally, a data set of nucleic acid character strings encoding monomer domains can be generated e.g., by mixing a first character string encoding a monomer domain, with one or more character string encoding a different monomer domain, thereby producing a data set of nucleic acids character strings encoding monomer domains, including those described herein. In another embodiment, the monomer domain and the different monomer domain can include one or more domains found in the Pfam database and/or the SMART database. The methods can further comprise inserting the first character string encoding the monomer domain and the one or more second character string encoding the different monomer domain in a computer and generating a multimer character string(s) or library(s), thereof in the computer.

The libraries can be screened for a desired property such as binding of a desired ligand or mixture of ligands. For example, members of the library of monomer domains can be displayed and prescreened for binding to a known or unknown ligand or a mixture of ligands. The monomer domain sequences can then be mutagenized (e.g., recombined, chemically altered, etc.) or otherwise altered and the new monomer domains can be screened again for binding to the ligand or the mixture of ligands with an improved affinity. The selected monomer domains can be combined or joined to form multimers, which can then be screened for an improved affinity or avidity or altered specificity for the ligand or the mixture of ligands. Altered specificity can mean that the specificity is broadened, e.g., binding of multiple related viruses, or optionally, altered specificity can mean that the specificity is narrowed, e.g., binding within a specific region of a ligand. Those of skill in the art will recognize that there are a number of methods available to calculate avidity. See, e.g., Mammen et al., *Angew Chem. Int. Ed.* 37:2754-2794 (1998); Muller et al., *Anal. Biochem.* 261:149-158 (1998).

VI. Selection of Monomer Domains that Bind IL-6

Preliminary screens can be conducted by screening for agents capable of binding to IL-6, as at least some of the agents so identified are likely IL-6 modulators (e.g., antagonists or agonists). The binding assays usually involve contacting an IL-6 protein (or a fragment thereof) with one or more test agents (i.e., monomers or multimers of the invention) and allowing sufficient time for the protein and test agents to form a binding complex. Any binding complexes formed can be detected using any of a number of established analytical techniques. Protein binding assays include, but are not limited to, immunohistochemical binding assays, flow cytometry or other assays. The IL-6 protein utilized in such assays can be naturally expressed, cloned or synthesized. Similar methods can be used to identify monomer domains or multimers that bind IgG.

The screening methods of the invention can be performed as in vitro or cell-based assays. Cell based assays can be performed in any cells in which IL-6 is expressed. Cell-based assays may involve whole cells or cell fractions containing an IL-6 receptor to screen for agent binding or modulation of activity of IL-6 by the agent. Exemplary cell types that can be used according to the methods of the invention include, e.g., any mammalian cells, as well as fungal cells, including yeast, and bacterial cells. Cells can be primary cells or tumor cells or other types of immortal cell lines. Of course, IL-6 can be expressed in cells that do not endogenously contain IL-6. Further, a membrane-bound version of IL-6 may be exogenously expressed on the surface of cells, allowing for flow cytometry or other binding, screening, or selection methods.

IL-6 activity assays may also be used to identify a modulator (antagonist or agonist) of IL-6. In these embodiments, one or more test agents are contacted to a cell expressing IL-6 or to which exogenous IL-6 has been added, and then tested for an activity of IL-6. Exemplary IL-6 activities include cell proliferation, inflammatory responses or differentiation. See, e.g., Naka, T. et al., *Arthritis Res.* 4:S233-S242 (2002). In other embodiments, downstream molecular events can also be monitored to determine signaling activity. For example, IL-6 signal transduction is mediated primarily by two pathways: the JAK-STAT (Janus family tyrosine Kinase—Signal Transducer and Activator of Transcription) pathway and the Ras mitogen-activated protein kinase pathway whose activation can be easily monitored using commercially available kits and methods known to those skilled in the art. See, e.g., See, e.g., Naka, T. et al., *Arthritis Res.* 4:S233-S242 (2002).

In some embodiments, activity assays are also used to confirm that identified antagonist monomers or multimers (i.e., that prevent binding of IL-6 to IL-6R) lack agonist activity (i.e., that they do not activate IL-6R in the absence of IL-6 or another agonist).

Agents that are initially identified by any of the foregoing screening methods can be further tested to validate the apparent activity. Such studies may be conducted with suitable animal models. The basic format of such methods involves administering a lead compound identified during an initial screen to an animal that serves as a model for humans and then determining if IL-6 is in fact modulated and/or the disease or condition is ameliorated. The animal models utilized in validation studies generally are mammals of any kind. Specific examples of suitable animals include, but are not limited to, primates, mice and rats.

Selection of monomer domains that bind IL-6 from a library of domains can be accomplished by a variety of procedures. For example, one method of identifying monomer domains which have a desired property (e.g., binding IL-6 or IgG) involves translating a plurality of nucleic acids, where each nucleic acid encodes a monomer domain, screening the polypeptides encoded by the plurality of nucleic acids, and identifying those monomer domains that, e.g., bind to a desired ligand or mixture of ligands, thereby producing a selected monomer domain. The monomer domains expressed by each of the nucleic acids can be tested for their ability to bind to the ligand by methods known in the art (i.e. panning, affinity chromatography, FACS analysis).

As mentioned above, selection of monomer domains can be based on binding to a ligand such as IL-6, or a fragment thereof or other target molecule (e.g., lipid, carbohydrate, nucleic acid and the like). Other molecules can optionally be included in the methods along with the target, e.g., ions such as $Ca^{+2}$.

When a monomer domain of the invention is selected based on its ability to bind to a ligand, the selection basis can include selection based on a slow dissociation rate, which is usually predictive of high affinity. The valency of the ligand can also be varied to control the average binding affinity of selected monomer domains. The ligand can be bound to a surface or substrate at varying densities, such as by including a competitor compound, by dilution, or by other method known to those in the art. High density (valency) of predetermined ligand can be used to enrich for monomer domains that have relatively low affinity, whereas a low density (valency) can preferentially enrich for higher affinity monomer domains.

A variety of reporting display vectors or systems can be used to express nucleic acids encoding the monomer domains and/or multimers of the present invention and to test for a desired activity. For example, a phage display system is a system in which monomer domains are expressed as fusion proteins on the phage surface (Pharmacia, Milwaukee Wis.). Phage display can involve the presentation of a polypeptide sequence encoding monomer domains on the surface of a filamentous bacteriophage, typically as a fusion with a bacteriophage coat protein.

Generally in these methods, each phage particle or cell serves as an individual library member displaying a single species of displayed polypeptide in addition to the natural phage or cell protein sequences. The nucleic acids are cloned into the phage DNA at a site which results in the transcription of a fusion protein, a portion of which is encoded by the plurality of the nucleic acids. The phage containing a nucleic acid molecule undergoes replication and transcription in the cell. The leader sequence of the fusion protein directs the transport of the fusion protein to the tip of the phage particle. Thus, the fusion protein that is partially encoded by the nucleic acid is displayed on the phage particle for detection and selection by the methods described above and below. For example, the phage library can be incubated with a predetermined ligand such as IL-6 or a fragment thereof, so that phage particles which present a fusion protein sequence that binds to the ligand can be differentially partitioned from those that do not present polypeptide sequences that bind to the predetermined ligand. For example, the separation can be provided by immobilizing the predetermined ligand. The phage particles (i.e., library members) which are bound to the immobilized ligand are then recovered and replicated to amplify the selected phage subpopulation for a subsequent round of affinity enrichment and phage replication. After several rounds of affinity enrichment and phage replication, the phage library members that are thus selected are isolated and the nucleotide sequence encoding the displayed polypeptide sequence is determined, thereby identifying the sequence(s) of polypeptides that bind to the predetermined ligand. Such methods are further described in PCT patent publication Nos. 91/17271, 91/18980, and 91/19818 and 93/08278.

Examples of other display systems include ribosome displays, a nucleotide-linked display (see, e.g., U.S. Pat. Nos. 6,281,344; 6,194,550, 6,207,446, 6,214,553, and 6,258,558), polysome display, cell surface displays and the like. The cell surface displays include a variety of cells, e.g., *E. coli*, yeast and/or mammalian cells. When a cell is used as a display, the nucleic acids, e.g., obtained by PCR amplification followed by digestion, are introduced into the cell and translated. Optionally, polypeptides encoding the monomer domains or the multimers of the present invention can be introduced, e.g., by injection, into the cell.

The monomer and multimer libraries of the invention can be screened for a desired property such as binding of a desired ligand (e.g., IL-6) or mixture of ligands. For example, members of the library of monomer domains can be displayed and prescreened for binding to a known or unknown ligand or a mixture of ligands. The monomer domain sequences can then be mutagenized (e.g., recombined, chemically altered, etc.) or otherwise altered and the new monomer domains can be screened again for binding to the ligand or the mixture of ligands with an improved affinity. The selected monomer domains can be combined or joined to form multimers, which can then be screened for an improved affinity or avidity or altered specificity for the ligand or the mixture of ligands. Altered specificity can mean that the specificity is broadened, e.g., binding of multiple related ligands, or optionally, altered specificity can mean that the specificity is narrowed, e.g., binding within a specific region of a ligand. Those of skill in the art will recognize that there are a number of methods available to calculate avidity. See, e.g., Mammen et al., *Angew Chem. Int. Ed.* 37:2754-2794 (1998); Muller et al., *Anal. Biochem.* 261:149-158 (1998).

Those of skill in the art will recognize that the steps of generating variation and screening for a desired property can be repeated (i.e., performed recursively) to optimize results. For example, in a phage display library or other like format, a first screening of a library can be performed at relatively lower stringency, thereby selected as many particles associated with a target molecule as possible. The selected particles can then be isolated and the polynucleotides encoding the monomer or multimer can be isolated from the particles. Additional variations can then be generated from these sequences and subsequently screened at higher affinity.

All the compositions of the present invention, e.g., monomer domains as well as multimers and libraries thereof can be optionally bound to a matrix of an affinity material. Examples of affinity material include beads, a column, a solid support, a microarray, other pools of reagent-supports, and the like.

When multimers capable of binding relatively large targets are desired, they can be generated by a "walking" selection method. This method is carried out by providing a library of monomer domains and screening the library of monomer domains for affinity to a first target molecule. Once at least one monomer that binds to the target is identified, that monomer is covalently linked to a new library or each remaining member of the original library of monomer domains. This new library of multimers (dimers) is then screened for multimers that bind to the target with an increased affinity, and a multimer that binds to the target with an increased affinity can be identified. The "walking" monomer selection method provides a way to assemble a multimer that is composed of monomers that can act additively or even synergistically with each other given the restraints of linker length. This walking technique is very useful when selecting for and assembling multimers that are able to bind large target proteins with high affinity. The walking method can be repeated to add more monomers thereby resulting in a multimer comprising 2, 3, 4, 5, 6, 7, 8 or more monomers linked together.

Figure 5:
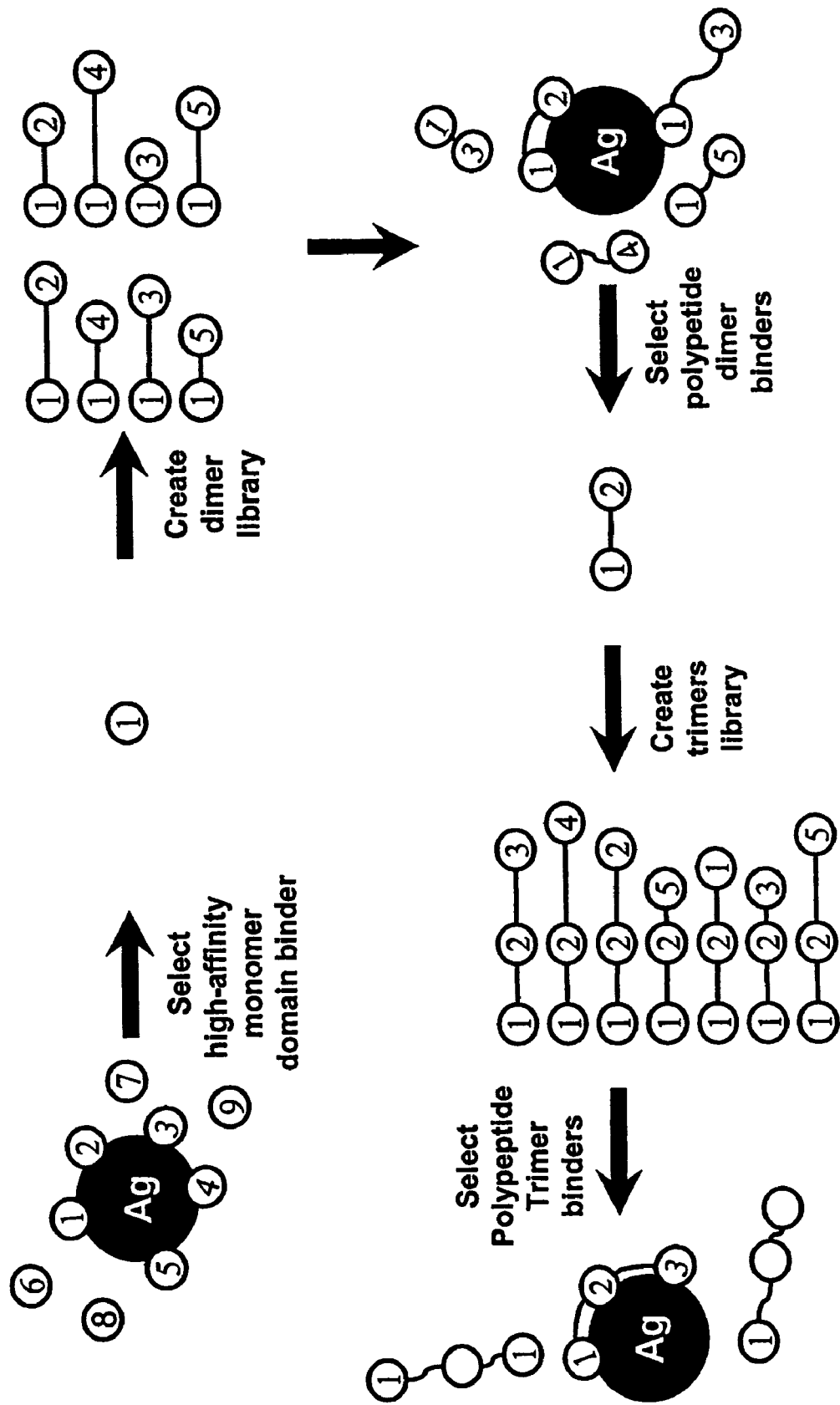
FIG. 5 is a schematic representation of another selection strategy (guided selection). A monomer domain with appropriate binding properties is identified from a library of monomer domains. The identified monomer domain is then linked to monomer domains from another library of monomer domains to form a library of multimers. The multimer library is screened to identify a pair of monomer domains that bind simultaneously to the target. This process can then be repeated until the optimal binding properties are obtained in the multimer.
Figure 8:
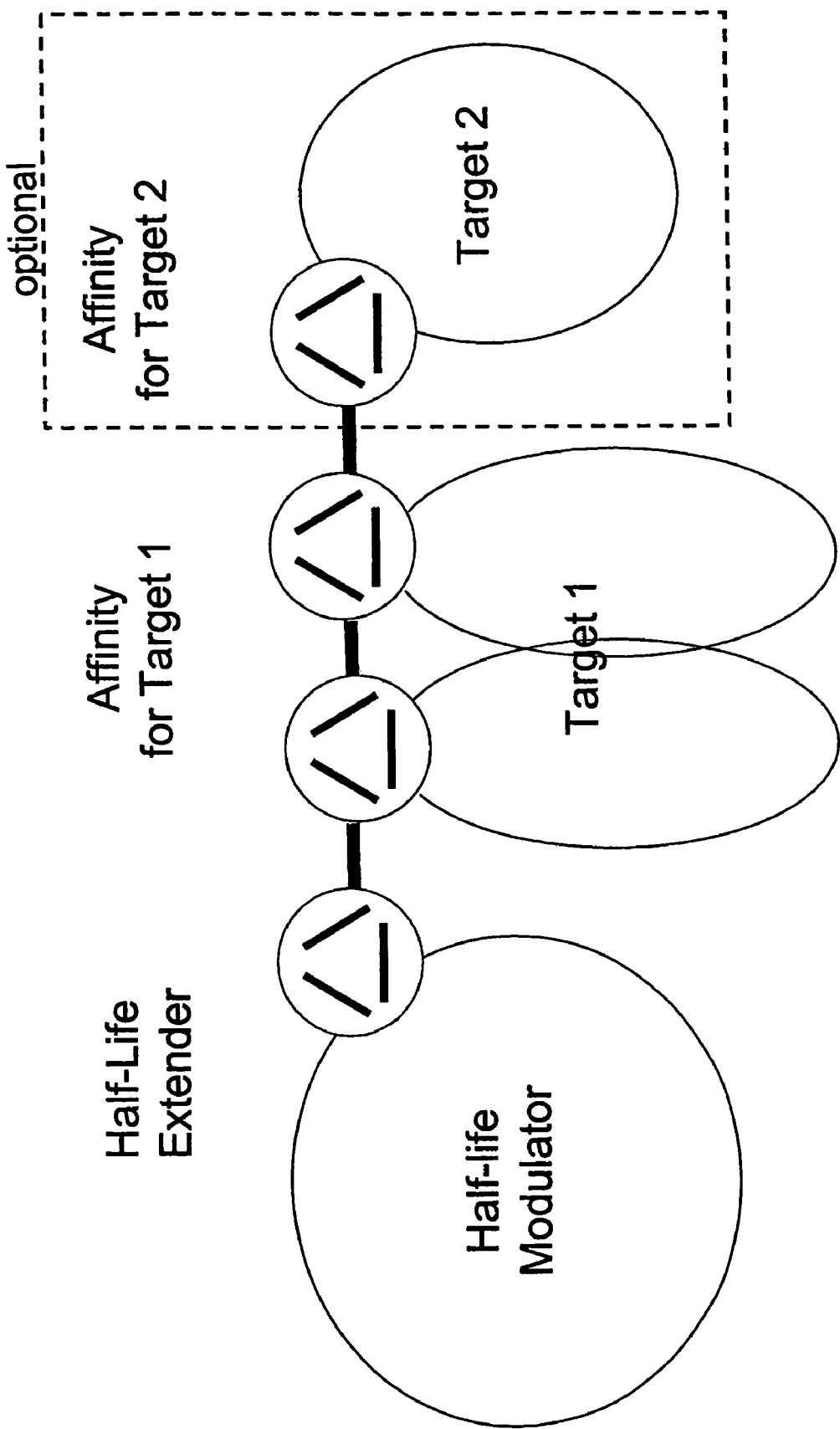
FIG. 8 depicts a possible conformation of a multimer of the invention comprising at least one monomer domain that binds to a half-life extending molecule and other monomer domains binding to one or optionally two or more target molecules. In the Figure, two monomer domains bind to two first target molecules. Optionally, the two monomer domains can bind to different sites on one first target molecule (not depicted).

In some embodiments, the selected multimer comprises more than two domains. Such multimers can be generated in a step fashion, e.g., where the addition of each new domain is tested individually and the effect of the domains is tested in a sequential fashion. See, e.g., FIG. 5. In an alternate embodiment, domains are linked to form multimers comprising more than two domains and selected for binding without prior knowledge of how smaller multimers, or alternatively, how each domain, bind.

The methods of the present invention also include methods of evolving monomers or multimers. Intra-domain recombination can be introduced into monomers across the entire monomer or by taking portions of different monomers to form new recombined units. Interdomain recombination (e.g., recombining different monomers into or between multimers) or recombination of modules (e.g., multiple monomers within a multimer) may be achieved. Inter-library recombination is also contemplated.

Methods for evolving monomers or multimers can comprise, e.g., any or all of the following steps: providing a plurality of different nucleic acids, where each nucleic acid encodes a monomer domain; translating the plurality of different nucleic acids, which provides a plurality of different monomer domains; screening the plurality of different monomer domains for binding of the desired ligand (e.g., IL-6) or mixture of ligands; identifying members of the plurality of different monomer domains that bind the desired ligand or mixture of ligands, which provides selected monomer domains; joining the selected monomer domains with at least one linker to generate at least one multimer, wherein the at least one multimer comprises at least two of the selected monomer domains and the at least one linker; and, screening the at least one multimer for an improved affinity or avidity or altered specificity for the desired ligand or mixture of ligands as compared to the selected monomer domains.

Variation can be introduced into either monomers or multimers. An example of improving monomers includes intra-domain recombination in which two or more (e.g., three, four, five, or more) portions of the monomer are amplified separately under conditions to introduce variation (for example by shuffling or other recombination method) in the resulting amplification products, thereby synthesizing a library of variants for different portions of the monomer. By locating the 5' ends of the middle primers in a "middle" or 'overlap' sequence that both of the PCR fragments have in common, the resulting "left" side and "right" side libraries may be combined by overlap PCR to generate novel variants of the original pool of monomers. These new variants may then be screened for desired properties, e.g., panned against a target or screened for a functional effect. The "middle" primer(s) may be selected to correspond to any segment of the monomer, and will typically be based on the scaffold or one or more consensus amino acids within the monomer (e.g., cysteines such as those found in A domains).

Similarly, multimers may be created by introducing variation at the monomer level and then recombining monomer variant libraries. On a larger scale, multimers (single or pools) with desired properties may be recombined to form longer multimers. In some cases variation is introduced (typically synthetically) into the monomers or into the linkers to form libraries. This may be achieved, e.g., with two different multimers that bind to two different targets, thereby eventually selecting a multimer with a portion that binds to one target and a portion that binds a second target.

Additional variation can be introduced by inserting linkers of different length and composition between domains. This allows for the selection of optimal linkers between domains. In some embodiments, optimal length and composition of linkers will allow for optimal binding of domains. In some embodiments, the domains with a particular binding affinity(s) are linked via different linkers and optimal linkers are selected in a binding assay. For example, domains are selected for desired binding properties and then formed into a library comprising a variety of linkers. The library can then be screened to identify optimal linkers. Alternatively, multimer libraries can be formed where the effect of domain or linker on target molecule binding is not known.

Methods of the present invention also include generating one or more selected multimers by providing a plurality of monomer domains. The plurality of monomer domains is screened for binding of a desired ligand or mixture of ligands. Members of the plurality of domains that bind the desired ligand or mixture of ligands are identified, thereby providing domains with a desired affinity. The identified domains are joined with at least one linker to generate the multimers, wherein each multimer comprises at least two of the selected domains and the at least one linker; and, the multimers are screened for an improved affinity or avidity or altered specificity for the desired ligand or mixture of ligands as compared to the selected domains, thereby identifying the one or more selected multimers.

Multimer libraries may be generated, in some embodiments, by combining two or more libraries or monomers or multimers in a recombinase-based approach, where each library member comprises as recombination site (e.g., a lox site). A larger pool of molecularly diverse library members in principle harbor more variants with desired properties, such as higher target-binding affinities and functional activities.

When libraries are constructed in phage vectors, which may be transformed into *E. coli*, library size ($10^9$-$10^{10}$) is limited by the transformation efficiency of *E. coli*. A recombinase/recombination site system (e.g., the Cre-loxP system) and in vivo recombination can be exploited to generate libraries that are not limited in size by the transformation efficiency of *E. coli*.

For example, the Cre-loxP system may be used to generate dimer libraries with $10^{10}$, $10^{11}$, $10^{12}$, $10^{13}$, or greater diversity. In some embodiments, *E. coli* as a host for one naïve monomer library and a filamentous phage that carries a second naïve monomer library are used. The library size in this case is limited only by the number of infective phage (carrying one library) and the number of infectible *E. coli* cells (carrying the other library). For example, infecting $10^{12}$ *E. coli* cells (1 L at OD600=1) with >$10^{12}$ phage could produce as many as $10^{12}$ dimer combinations.

Selection of multimers can be accomplished using a variety of techniques including those mentioned above for identifying monomer domains. Other selection methods include, e.g., a selection based on an improved affinity or avidity or altered specificity for the ligand compared to selected monomer domains. For example, a selection can be based on selective binding to specific cell types, or to a set of related cells or protein types (e.g., different virus serotypes). Optimization of the property selected for, e.g., avidity of a ligand, can then be achieved by recombining the domains, as well as manipulating amino acid sequence of the individual monomer domains or the linker domain or the nucleotide sequence encoding such domains, as mentioned in the present invention.

One method for identifying multimers can be accomplished by displaying the multimers. As with the monomer domains, the multimers are optionally expressed or displayed on a variety of display systems, e.g., phage display, ribosome display, polysome display, nucleotide-linked display (see, e.g., U.S. Pat. Nos. 6,281,344; 6,194,550, 6,207,446, 6,214,553, and 6,258,558) and/or cell surface display, as described above. Cell surface displays can include but are not limited to *E. coli*, yeast or mammalian cells. In addition, display libraries of multimers with multiple binding sites can be panned for avidity or affinity or altered specificity for a ligand or for multiple ligands.

Monomers or multimers can be screened for target binding activity in yeast cells using a two-hybrid screening assay. In this type of screen the monomer or multimer library to be screened is cloned into a vector that directs the formation of a fusion protein between each monomer or multimer of the library and a yeast transcriptional activator fragment (i.e., Gal4). Sequences encoding the "target" protein are cloned into a vector that results in the production of a fusion protein between the target and the remainder of the Gal4 protein (the DNA binding domain). A third plasmid contains a reporter gene downstream of the DNA sequence of the Gal4 binding site. A monomer that can bind to the target protein brings with it the Gal4 activation domain, thus reconstituting a functional Gal4 protein. This functional Gal4 protein bound to the binding site upstream of the reporter gene results in the expression of the reporter gene and selection of the monomer or multimer as a target binding protein. (see Chien et. al. (1991) *Proc. Natl. Acad. Sci.* (USA) 88:9578; Fields S, and Song O. (1989) *Nature* 340: 245) Using a two-hybrid system for library screening is further described in U.S. Pat. No. 5,811,238 (see also Silver S. C. and Hunt S. W. (1993) *Mol. Biol. Rep.* 17:155; Durfee et al. (1993) *Genes Devel.* 7:555; Yang et al. (1992) *Science* 257:680; Luban et al. (1993) *Cell* 73:1067; Hardy et al. (1992) *Genes Devel.* 6:801; Bartel et al. (1993) *Biotechniques* 14:920; and Vojtek et al. (1993) *Cell* 74:205).

Another useful screening system for carrying out the present invention is the *E. coli*/BCCP interactive screening system (Germino et al. (1993) *Proc. Nat. Acad. Sci.* (U.S.A.) 90:993; Guarente L. (1993) *Proc. Nat. Acad. Sci.* (U.S.A.) 90:1639).

Other variations include the use of multiple binding compounds, such that monomer domains, multimers or libraries of these molecules can be simultaneously screened for a multiplicity of ligands or compounds that have different binding specificity. Multiple predetermined ligands or compounds can be concomitantly screened in a single library, or sequential screening against a number of monomer domains or multimers. In one variation, multiple ligands or compounds, each encoded on a separate bead (or subset of beads), can be mixed and incubated with monomer domains, multimers or libraries of these molecules under suitable binding conditions. The collection of beads, comprising multiple ligands or compounds, can then be used to isolate, by affinity selection, selected monomer domains, selected multimers or library members. Generally, subsequent affinity screening rounds can include the same mixture of beads, subsets thereof, or beads containing only one or two individual ligands or compounds. This approach affords efficient screening, and is compatible with laboratory automation, batch processing, and high throughput screening methods.

In another embodiment, multimers can be simultaneously screened for the ability to bind multiple ligands, wherein each ligand comprises a different label. For example, each ligand can be labeled with a different fluorescent label, contacted simultaneously with a multimer or multimer library. Multimers with the desired affinity are then identified (e.g., by FACS sorting) based on the presence of the labels linked to the desired labels.

Libraries of either monomer domains or multimers (referred in the following discussion for convenience as "affinity agents") can be screened (i.e., panned) simultaneously against multiple ligands in a number of different formats. For example, multiple ligands can be screened in a simple mixture, in an array, displayed on a cell or tissue (e.g., a cell or tissue provides numerous molecules that can be bound by the monomer domains or multimers of the invention), and/or immobilized. The libraries of affinity agents can optionally be displayed on yeast or phage display systems. Similarly, if desired, the ligands (e.g., encoded in a cDNA library) can be displayed in a yeast or phage display system.

Initially, the affinity agent library is panned against the multiple ligands. Optionally, the resulting "hits" are panned against the ligands one or more times to enrich the resulting population of affinity agents.

If desired, the identity of the individual affinity agents and/or ligands can be determined. In some embodiments, affinity agents are displayed on phage. Affinity agents identified as binding in the initial screen are divided into a first and second portion. The first portion is infected into bacteria, resulting in either plaques or bacterial colonies, depending on the type of phage used. The expressed phage are immobilized and then probed with ligands displayed in phage selected as described below.

The second portion are coupled to beads or otherwise immobilized and a phage display library containing at least some of the ligands in the original mixture is contacted to the immobilized second portion. Phage that bind to the second portion are subsequently eluted and contacted to the immobilized phage described in the paragraph above. Phage-phage interactions are detected (e.g., using a monoclonal antibody specific for the ligand-expressing phage) and the resulting phage polynucleotides can be isolated.

In some embodiments, the identity of an affinity agent-ligand pair is determined. For example, when both the affinity agent and the ligand are displayed on a phage or yeast, the DNA from the pair can be isolated and sequenced. In some embodiments, polynucleotides specific for the ligand and affinity agent are amplified. Amplification primers for each reaction can include 5' sequences that are complementary such that the resulting amplification products are fused, thereby forming a hybrid polynucleotide comprising a polynucleotide encoding at least a portion of the affinity agent and at least a portion of the ligand. The resulting hybrid can be used to probe affinity agent or ligand (e.g., cDNA-encoded) polynucleotide libraries to identify both affinity agent and ligand.

The above-described methods can be readily combined with "walking" to simultaneously generate and identify multiple multimers, each of which bind to a ligand in a mixture of ligands. In these embodiments, a first library of affinity agents (monomer domains or multimers) are panned against multiple ligands and the eluted affinity agents are linked to the first or a second library of affinity agents to form a library of multimeric affinity agents (e.g., comprising 2, 3, 4, 5, 6, 7, 8, 9, or more monomer), which are subsequently panned against the multiple ligands. This method can be repeated to continue to generate larger multimeric affinity agents. Increasing the number of monomer domains may result in increased affinity and avidity for a particular target. For example, the inventors have found that trimers of monomer domains that bind CD28 have a higher affinity than dimers, which in turn have a higher affinity than single CD28-binding monomer domains alone. Of course, at each stage, the panning is optionally repeated to enrich for significant binders. In some cases, walking will be facilitated by inserting recombination sites (e.g., lox sites) at the ends of monomers and recombining monomer libraries by a recombinase-mediated event.

The selected multimers of the above methods can be further manipulated, e.g., by recombining or shuffling the selected multimers (recombination can occur between or within multimers or both), mutating the selected multimers, and the like. This results in altered multimers which then can be screened and selected for members that have an enhanced property compared to the selected multimer, thereby producing selected altered multimers.

In view of the description herein, it is clear that the following process may be followed. Naturally or non-naturally occurring monomer domains may be recombined or variants may be formed. Optionally the domains initially or later are selected for those sequences that are less likely to be immunogenic in the host for which they are intended. Optionally, a phage library comprising the recombined domains is panned for a desired affinity. Monomer domains or multimers expressed by the phage may be screened for $IC_{50}$ for a target. Hetero- or homo-meric multimers may be selected. The selected polypeptides may be selected for their affinity to any target, including, e.g., hetero- or homo-multimeric targets.

Linkers, multimers or selected multimers produced by the methods indicated above and below are features of the present invention. Libraries comprising multimers, e.g, a library comprising about 100, 250, 500 or more members produced by the methods of the present invention or selected by the methods of the present invention are provided. In some embodiments, one or more cell comprising members of the libraries, are also included. Libraries of the recombinant polypeptides are also a feature of the present invention, e.g., a library comprising about 100, 250, 500 or more different recombinant polypeptides.

Compositions of the present invention can be bound to a matrix of an affinity material, e.g., the recombinant polypeptides. Examples of affinity material include, e.g., beads, a column, a solid support, and/or the like.

VII. Methods of Treating, Preventing, and Ameliorating Diseases, Disorders, and Conditions The present invention also includes methods of therapeutically or prophylactically treating a disease, disorder, or condition by administering in vivo or ex vivo one or more nucleic acids or polypeptides of the invention described above (or compositions comprising a pharmaceutically acceptable excipient and one or more such nucleic acids or polypeptides) to a subject, including, e.g., a mammal, including a human, primate, mouse, pig, cow, goat, rabbit, rat, guinea pig, hamster, horse, sheep; or a non-mammalian vertebrate such as a bird (e.g., a chicken or duck), fish, or invertebrate.

IL-6 antagonists, including polypeptides comprising IL-6-binding monomer domains or multimers of the invention are useful in treatment of a number of human diseases. Exemplary IL-6-binding domains include the specific sequences disclosed herein, including, but not limited to:

```
Family 1 motif (SEQ ID NO: 27):
CX [AS] [DN] EFXCXXGXC [ILV] XXAXXCDGV [DN]
DCXDNSDEXXC [AST] XX [AST]

Family 2 motif (SEQ ID NO: 28):
CXXXQFXC [DN] NGXCVPXXWXCDG [DE] [DN] DCXD [DN]
SDEXXCXXP [AST]

Family 3 motif (SEQ ID NO: 29):
CXXXQFQCXSG [W, Y] C [I, L, F] XXXW [V, L]
CDGXNDCEDXSDEXXC Family 4 motif (SEQ ID NO: 30):
CXXX [EQ] FXCXXGXC [ILV] XXXXXCDGX [DN] DCXDXSDEXX
(XX) C Family 5 motif (SEQ ID NO: 31):
CX [A, P] X [E, Q] FXCXXGQC [I, L] PXXXXCDGX [D,
N] DCXDXSDEXXC Family 6 motif (SEQ ID NO: 32):
CXXX [EQ] FXCX (X) SXXC [ILV] XX [DN] W [ILV]
CDGVNDCXDXSDEXGCXXXT Family 7 motif (SEQ ID NO: 33):
CL [AS] X [EQ] FXCXNGXCIP [KQR] XWVCDGDNDC [ILV]
DXSDE (P) XXCX [EKQ] XT.
```

As is known in the art, IL-6 is a pleiotropic cytokine with a wide range of biological activities in immune regulation, inflammation, hematopoiesis, and oncogenesis. Naka et al., Arthritis Res 4:S233-S242 (2002). Overproduction of IL-6 has been associated with various disease conditions such as inflammation, autoimmune, and malignant diseases. Thus, antagonism of IL-6 may treat, ameliorate, or prevent such disease, disorders, or conditions in a patient.

In certain embodiments, antagonism of IL-6 may treat, ameliorate, or prevent an inflammatory disease, disorder, or condition in a patient. In certain embodiments, antagonism of IL-6 may treat, ameliorate, or prevent inflammation.

Inflammation is the body's defense reaction to injuries such as those caused by mechanical damage, infection, or antigenic stimulation. The recruitment of immune cells to sites of injury involves the concerted interactions of many soluble mediators, e.g. IL-6. An inflammatory reaction may be pathological when inflammation is induced by an otherwise innocuous or inappropriate stimulus or when inflammation persists well after the removal of the agent. Pathological inflammatory reactions may cause tissue damage and disease, e.g. Crohn's disease and ulcerative colitis. Diseases caused by pathological inflammation may be defined based on the location of the inflammation; e.g. Crohn's disease and ulcerative colitis involve inflammation of the gastrointestinal tract while rheumatoid arthritis involves inflammation of the synovium of the joints. Thus, reducing or inhibiting pathogenic inflammation through antagonism of IL-6 may provide a therapy for such inflammatory diseases, disorders, or conditions.

The diseases that may be addressed by the invention include, in addition to Crohn's disease and rheumatoid arthritis, inflammatory and autoimmune diseases such as psoriasis, psoriatic arthritis, juvenile rheumatoid arthritis, systemic juvenile idiopathic arthritis, familial Mediterranean fever, tumor necrosis factor alpha receptor associated periodic syndrome (TRAPS), post-transplant lymphoproliferative disorder (PTLD), cachexia, myasthenia gravis, polymyositis, dermatomyositis, giant cell arteritis, polymyalgia rheumatica, Still's disease, asthma, chronic obstructive pulmonary disease, interstitial pulmonary fibrosis, systemic lupus erythematosus, lupus nephritis, multiple sclerosis, osteoarthritis, Castleman's disease, sepsis, Guillan Barre syndrome, post-transplant lymphoproliferative disease, arthrosclerosis, coronary artery disease, multiple sclerosis, Parkinson's disease, Alzheimer's disease, stroke, type II diabetes, and diabetic macular edema.

In various embodiments, antagonism of IL-6 may treat, ameliorate, or prevent an immune system-mediated disease, disorder, or condition in a patient. In some embodiments, the immune response is an IgE-mediated response.

In vivo, IgE is predominantly found bound to mast cells and basophils via its receptor, FcεRI. This process, referred to as sensitization, renders mast cells and basophils primed for antigen-specific activation. Mast cells store preformed mediators, including histamine, proteoglycans, and serine proteases, in intracellular granules. When mast cell-bound IgE recognizes its cognate antigen, FcεRI aggregates, causing the mast cell to release the contents of the intracellular granules in addition to lipid mediators and cytokines, e.g. IL-6. The released mast cell contents induce smooth muscle constriction and inflammation, and alter venular permeability. Such effects may induce pathological inflammation and possibly death. Inhibiting IgE production through antagonism of IL-6 may provide a defense against IgE-mediated pathologies.

IgE-mediated diseases, disorders, or conditions, include, but are not limited to, type I allergic reactions, allergic rhinitis, sinusitis, chronic or recurrent otitis media, drug reactions, insect sting reactions, latex reactions, conjunctivitis, urticaria, anaphylaxis and anaphylactoid reactions, atopic dermatitis, and food allergies (peanuts, shellfish, etc.).

In addition, in view of the actions of IL-6 as a growth factor, antagonism of IL-6 may treat, ameliorate, or prevent the growth of tumor and non-tumor cells. In some embodiments, IL-6 antagonism may address cancer such as multiple myeloma, plasmacytoma, renal cell carcinoma, breast cancer, other solid tumors (colon, pancreatic, gastric, etc.), lymphoma, and leukemia. In some embodiments, IL-6 antagonism may address diseases and/or conditions such as polyclonal hypergammaglobulinemia, mesangial proliferative glomerulonephritis, osteoporosis, Paget's disease, anti-aging, liver disorders (e.g., liver fibrosis) and lymphocytic interstitial pneumonia.

In some embodiments, a polypeptide comprising a monomer or multimer of the invention that binds and antagonizes IL-6 is used to increase high density lipids (HDLs) in an individual. The individual may be one who has a family history of heart disease or otherwise is at risk from ill health effects of high cholesterol, high LDL levels or low HDL levels. IL-6 is an important mediator of lipid metabolism. This is evidenced by the fact that cholesterol levels go up in the IL-6 knockout mouse, but in IL-6 transgenic mice the cholesterol levels go down. Human anti-IL-6R antibodies cause the total cholesterol level, LDL level, and triglyceride level to go up significantly (P=<0.001). HDL goes up significantly as well (P=<0.001). LDL goes up 12-23% in dose-dependent manner with humanized anti-IL-6R antibody (MRA). HDL goes up ~26% in dose-dependent manner with same anti-IL-6R antibody. See, e.g., Nishimoto et al, *Journal of Rheumatology* (2003); Nishimoto et al, *Arthritis & Rheumatism* (2004).

In some embodiments, IL-6 antagonism may treat, ameliorate, or prevent a disease associated with dyslipidemias, as part of treating e.g., atherosclerosis, coronary artery disease, etc.).

In some embodiments, administering to a patient a polypeptide comprising a monomer or multimer of the invention that binds IL-6 may treat, prevent, or ameliorate one or more symptoms of a disease, condition, or disorder. In some embodiments, administering to a patient a polypeptide comprising a monomer or multimer of the invention that binds IL-6 may treat, prevent, or ameliorate ancillary symptoms of the disease, condition, or disorder, including, but not limited to, weight loss, fever, fatigue, and/or anemia.

In some aspects, a monomer or multimer of the invention is administered to an individual with at least one other molecule used for treatment of one of the above-listed ailments. The other molecule can be prepared in a formulation with the monomer or multimer or can be administered simultaneously or before or after the monomer or multimer is administered. For example, in some embodiments, a polypeptide comprising a monomer or multimer of the invention that binds IL-6 is administered in combination with a drug that reduces LDL levels. Statins, resins (cholestyramine, colestipol, colesevalam) and nicotinic acid are examples of a drugs that reduces LDL levels. Exemplary statins include, but are not limited to, atorvastatin, fluvastatin, lovastatin, pravastatin, rosuvastatin, and simvastatin.

The invention provides in vivo methods in which one or more cells or a population of cells of interest of the subject are contacted directly or indirectly with an amount of a selected monomer domain and/or multimer of the invention effective in treating or ameliorating the disease, disorder, or other condition.

In in vivo direct contact/administration formats, the selected monomer domain and/or multimer is typically administered or transferred directly to the cells to be treated or to the tissue site of interest (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) by any of a variety of formats, including topical administration, injection (e.g., by using a needle or syringe), or vaccine or gene gun delivery, pushing into a tissue, organ, or skin site. The selected monomer domain and/or multimer can be delivered, for example, intramuscularly, intradermally, subdermally, subcutaneously, orally, intraperitoneally, intrathecally, intravenously, or placed within a cavity of the body (including, e.g., during surgery), or by inhalation or vaginal or rectal administration. Exemplary delivery includes, e.g., oral delivery (buccal or intestinal uptake/delivery), home injection (e.g., formulated in about a 1.4 ml volume or less), transdermal uptake/delivery, subcutaneously implantable pump, pulmonary uptake/delivery (systemic or non-systemic), blood-brain-barrier uptake/delivery, and/or nasal uptake/delivery.

In in vivo indirect contact/administration formats, the selected monomer domain and/or multimer is typically administered or transferred indirectly to the cells to be treated or to the tissue site of interest, including those described above (such as, e.g., skin cells, organ systems, lymphatic system, or blood cell system, etc.), by contacting or administering the polypeptide of the invention directly to one or more cells or population of cells from which treatment can be facilitated. For example, tumor cells within the body of the subject can be treated by contacting cells of the blood or lymphatic system, skin, or an organ with a sufficient amount of the selected monomer domain and/or multimer such that delivery of the selected monomer domain and/or multimer to the site of interest (e.g., tissue, organ, or cells of interest or blood or lymphatic system within the body) occurs and effective prophylactic or therapeutic treatment results. Such contact, administration, or transfer is typically made by using one or more of the routes or modes of administration described above.

Design approaches for delivery include, e.g., including in the monomer or multimer a binding affinity for mucosal peptide transporters such as PepT1, PepT2, HPT1, ABC-family, TAP1, TAP2, MDR; addition of a translocation domain (PE38 or PE40 from *Pseudomonas* exotoxin A) to the monomer or multimer; or including a binding affinity for blood-brain barrier transporters such as Transferrin receptor. Such receptors are called transporters. Another such receptor is the neonatal immunoglobulin Fc receptor (FcRn) which can be used for pulmonary and intestinal delivery to the serum. Alternatively, the monomer or multimer is designed to bind to the neonatal Fc receptor for pulmonary and intestinal transport. This method can involve engineering the final drug product for pH sensitive release.

The four primary mechanisms for transepithelial delivery are:

Transcellular: through the cell by diffusion: mostly used by small molecules.

Paracellular: around the cells through desmosomes/tight junctions: mostly used by hydrophilic peptides Transcytosis: through the cells inside vesicles by pinocytosis Carrier- or Transporter-mediated, for molecules that bind to the transporter/carrier Other strategies are possible. Other useful binders can be identified by identifying monomers or multimers that bind to Caco2 cells (e.g., using an uptake blocking assay using 14C-Cephalexin uptake by Caco2 cells). See, e.g., Blanchette, J., et al. *Biomedicine and Pharmacotherapy* 58:142-151 (2004); Low, S. C., et al. *Human Reproduction*—advance access Apr. 7, 2005; Lee, V. J. *Natl Cancer Institute*, Monographs 29 (2001); Rubas, W., et al. *J. Pharm. Sci.* 85:165-169 (1996); Yang, C. Y., et al. *Pharmaceutical Research* 16:1331-1343 (1999); Dietrich, C. G., et al. *Gut* 52:1788-1799 (2003); Cleland, J. L., et al. *Current Opinion in Biotechnology* 12:212-219 (2001); Nielsen, C. U. and Brodin, B. *Current Drug Targets* 4:373-388 (2004); Kunta, J. R., et al. *Current Drug Metabolism* 5:109-124 (2004).

In another approach, a phage library of multimers can be applied to the oral cavity of a mammal and phage or DNA from the phage can be recovered in the serum of the animal to enrich for sequences that are good delivery agents. Natural domains or peptides that are known to be orally transported can also be fused to monomers or multimers of the invention.

In yet another alternative, phage displayed domains are selected for resistance to the appropriate body fluid (nasal, intestinal, etc) or to purified proteases.

The invention also provides ex vivo methods of administration that may involve the administration of either the polypeptides themselves or the polynucleotides that encode the polypeptides. Thus, in one aspect, one or more cells or a population of cells of interest of the subject (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) are obtained or removed from the subject and contacted with an amount of a selected monomer domain and/or multimer of the invention that is effective to treat, ameliorate, or prevent the disease, disorder, or other condition. The contacted cells are then returned or delivered to the subject to the site from which they were obtained or to another site (e.g., including those defined above) of interest in the subject to be treated. If desired, the contacted cells can be grafted onto a tissue, organ, or system site (including all described above) of interest in the subject using standard and well-known grafting techniques or, e.g., delivered to the blood or lymph system using standard delivery or transfusion techniques.

In another aspect, the ex vivo methods similarly include the removal of one or more cells of interest or a population of cells of interest of the subject (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) followed by transformation by contacting said one or more cells or population of cells with a polynucleotide construct comprising a nucleic acid sequence of the invention that encodes a biologically active polypeptide of interest (e.g., a selected monomer domain and/or multimer) that is effective in treating, preventing, or ameliorating the disease, disorder, or other condition. The one or more cells or population of cells is contacted with a sufficient amount of the polynucleotide construct and a promoter controlling expression of said nucleic acid sequence such that uptake of the polynucleotide construct (and promoter) into the cell(s) occurs and sufficient expression of the target nucleic acid sequence of the invention results to produce an amount of the biologically active polypeptide, encoding a selected monomer domain and/or multimer, effective to treat, prevent, or ameliorate the disease, disorder, or condition.

The polynucleotide construct can include a promoter sequence (e.g., CMV promoter sequence) that controls expression of the nucleic acid sequence of the invention and/or, if desired, one or more additional nucleotide sequences encoding at least one or more of another polypeptide of the invention, a cytokine, adjuvant, or co-stimulatory molecule, or other polypeptide of interest.

Following transfection, the transformed cells are returned, delivered, or transferred to the subject to the tissue site or system from which they were obtained or to another site (e.g., tumor cells, tumor tissue sample, organ cells, blood cells, cells of the skin, lung, heart, muscle, brain, mucosae, liver, intestine, spleen, stomach, lymphatic system, cervix, vagina, prostate, mouth, tongue, etc.) to be treated in the subject. If desired, the cells can be grafted onto a tissue, skin, organ, or body system of interest in the subject using standard and well-known grafting techniques or delivered to the blood or lymphatic system using standard delivery or transfusion techniques. Such delivery, administration, or transfer of transformed cells is typically made by using one or more of the routes or modes of administration described above. Expression of the target nucleic acid occurs naturally or can be induced (as described in greater detail below) and an amount of the encoded polypeptide is expressed sufficient and effective to treat the disease or condition at the site or tissue system.

In yet another aspect, the invention provides in vivo methods in which one or more cells of interest or a population of cells of the subject (e.g., including those cells and cells systems and subjects described above) are transformed in the body of the subject by contacting the cell(s) or population of cells with (or administering or transferring to the cell(s) or population of cells using one or more of the routes or modes of administration described above) a polynucleotide construct comprising a nucleic acid sequence of the invention that encodes a biologically active polypeptide of interest (e.g., a selected monomer domain and/or multimer) that is effective in treating, preventing, or ameliorating the disease, disorder, or other condition.

The polynucleotide construct can be directly administered or transferred to cell(s) suffering from the disease, disorder, or condition (e.g., by direct contact using one or more of the routes or modes of administration described above). Alternatively, the polynucleotide construct can be indirectly administered or transferred to cell(s) suffering from the disease, disorder, or condition by first directly contacting non-diseased cell(s) or other diseased cells using one or more of the routes or modes of administration described above with a sufficient amount of the polynucleotide construct comprising the nucleic acid sequence encoding the biologically active polypeptide, and a promoter controlling expression of the nucleic acid sequence, such that uptake of the polynucleotide construct (and promoter) into the cell(s) occurs and sufficient expression of the nucleic acid sequence of the invention results to produce an amount of the biologically active polypeptide effective to treat, prevent, or ameliorate the disease, disorder, or condition, and whereby the polynucleotide construct or the resulting expressed polypeptide is transferred naturally or automatically from the initial delivery site, system, tissue or organ of the subject's body to the diseased site, tissue, organ or system of the subject's body (e.g., via the blood or lymphatic system). Expression of the target nucleic acid occurs naturally or can be induced (as described in greater detail below) such that an amount of expressed polypeptide is sufficient and effective to treat the disease or condition at the site or tissue system. The polynucleotide construct can include a promoter sequence (e.g., CMV promoter sequence) that controls expression of the nucleic acid sequence and/or, if desired, one or more additional nucleotide sequences encoding at least one or more of another polypeptide of the invention, a cytokine, adjuvant, or co-stimulatory molecule, or other polypeptide of interest.

In the in vivo and ex vivo treatment methods as described above, a composition comprising an excipient and the polypeptide or nucleic acid of the invention can be administered or delivered. In one aspect, a composition comprising a pharmaceutically acceptable excipient and a polypeptide or nucleic acid of the invention is administered or delivered to the subject as described above in an amount effective to treat the disease, disorder, or condition.

In another aspect, in the in vivo and ex vivo treatment methods described above, the amount of polynucleotide administered to the cell(s) or subject can be an amount such that uptake of said polynucleotide into one or more cells of the subject occurs and sufficient expression of said nucleic acid sequence results to produce an amount of a biologically active polypeptide effective to enhance an immune response in the subject, including an immune response induced by an immunogen (e.g., antigen). In another aspect, for each such method, the amount of polypeptide administered to cell(s) or subject can be an amount sufficient to enhance an immune response in the subject, including that induced by an immunogen (e.g., antigen).

In yet another aspect, in an in vivo or ex vivo treatment method in which a polynucleotide construct (or composition comprising a polynucleotide construct) is used to deliver a physiologically active polypeptide to a subject, the expression of the polynucleotide construct can be induced by using an inducible on- and off-gene expression system. Examples of such on- and off-gene expression systems include the Tet-On™ Gene Expression System and Tet-Off™ Gene Expression System (see, e.g., Clontech Catalog 2000, pg. 110-111 for a detailed description of each such system), respectively. Other controllable or inducible on- and off-gene expression systems are known to those of ordinary skill in the art. With such system, expression of the target nucleic of the polynucleotide construct can be regulated in a precise, reversible, and quantitative manner. Gene expression of the target nucleic acid can be induced, for example, after the stable transfected cells containing the polynucleotide construct comprising the target nucleic acid are delivered or transferred to or made to contact the tissue site, organ or system of interest. Such systems are of particular benefit in treatment methods and formats in which it is advantageous to delay or precisely control expression of the target nucleic acid (e.g., to allow time for completion of surgery and/or healing following surgery; to allow time for the polynucleotide construct comprising the target nucleic acid to reach the site, cells, system, or tissue to be treated; to allow time for the graft containing cells transformed with the construct to become incorporated into the tissue or organ onto or into which it has been spliced or attached, etc.).

VIII. Additional Multimer Uses

The potential applications of multimers of the present invention are diverse and include any use where an affinity agent is desired.

In some cases, a pair of monomers or multimers are selected to bind to the same target (i.e., for use in sandwich-based assays). To select a matched monomer or multimer pair, two different monomers or multimers typically are able to bind the target protein simultaneously. One approach to identify such pairs involves the following:

(1) immobilizing the phage or protein mixture that was previously selected to bind the target protein (2) contacting the target protein to the immobilized phage or protein and washing;

(3) contacting the phage or protein mixture to the bound target and washing; and (4) eluting the bound phage or protein without eluting the immobilized phage or protein.

One use of the multimers or monomer domains of the invention is to replace antibodies or other affinity agents in detection or other affinity-based assays. Thus, in some embodiments, monomer domains or multimers are selected against the ability to bind components other than a target in a mixture. The general approach can include performing the affinity selection under conditions that closely resemble the conditions of the assay, including mimicking the composition of a sample during the assay. Thus, a step of selection could include contacting a monomer domain or multimer to a mixture not including the target ligand and selecting against any monomer domains or multimers that bind to the mixture.

Thus, the mixtures (absent the target ligand, which could be depleted using an antibody, monomer domain or multimer) representing the sample in an assay (serum, blood, tissue, cells, urine, semen, etc) can be used as a blocking agent. Such subtraction is useful, e.g., to create pharmaceutical proteins that bind to their target but not to other serum proteins or non-target tissues.

Figure 9:
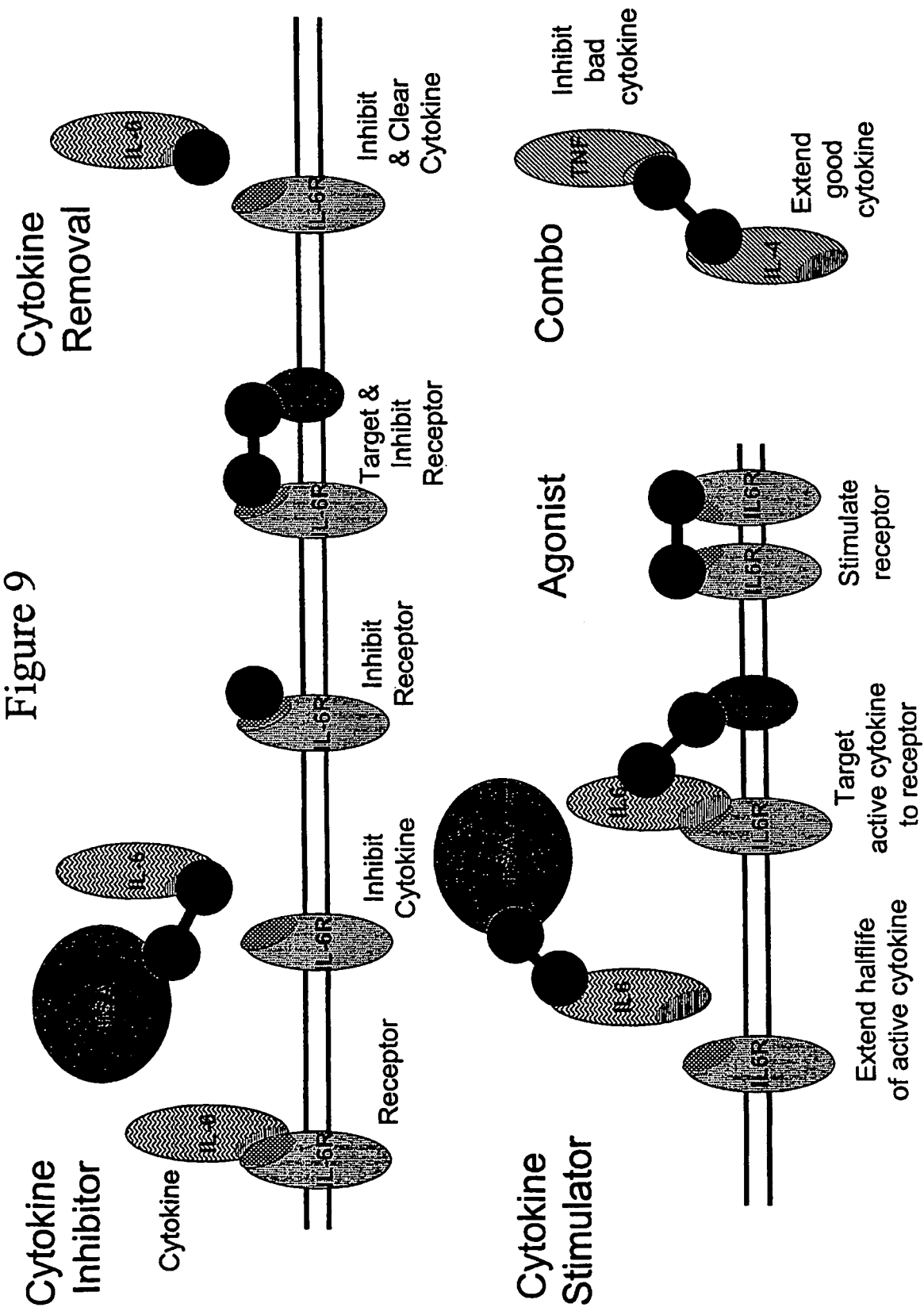
FIG. 9 shows possible designs of polypeptides of the invention that prevent IL-6/IL-6R.
Figure 10:
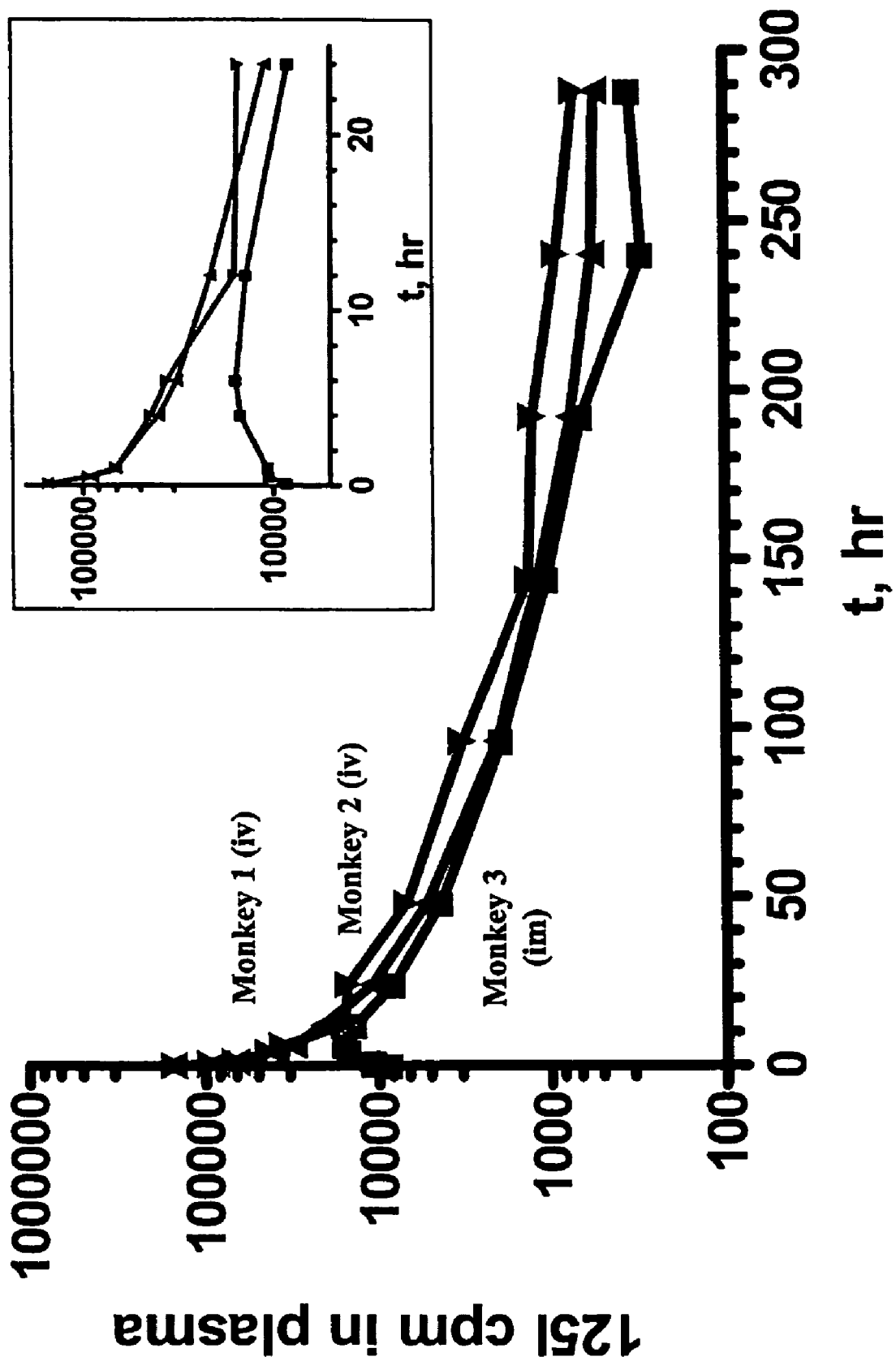
FIG. 10 illustrates the serum half-life in monkeys of monomers that bind to IgG.

For example, the invention can be used in the application for creating antagonists, where the selected monomer domains or multimers block the interaction between two proteins, e.g., IL-6 and IL-6 R. In some embodiments, monomers can be identified that prevent this interaction either by binding IL-6 or IL-6R. See, e.g., FIG. 9. Optionally, the invention can generate agonists. For example, multimers binding two different proteins, e.g., enzyme and substrate, can enhance protein function, including, for example, enzymatic activity and/or substrate conversion.

In some embodiments, the monomer domains are used for ligand inhibition, ligand clearance or ligand stimulation. Possible ligands in these methods, include, e.g., IL-6.

If inhibition of ligand binding to a receptor is desired, a monomer domain is selected that binds to the ligand (e.g., IL-6) at a portion of the ligand that contacts the ligand's receptor, or that binds to the receptor at a portion of the receptor that binds contacts the ligand, thereby preventing the ligand-receptor interaction. The monomer domains can optionally be linked to a half-life extender, if desired.

Ligand clearance refers to modulating the half-life of a soluble ligand in bodily fluid. Antibodies against cytokines typically prevent the clearance of the cytokine because the serum half-life of the antibody is much longer than the serum half-life of the cytokine (2-3 weeks versus a few hours). This causes a large increase in the concentration of the cytokine in the serum. In the case of IL-6 this increase was reported to be 700-fold (van Zaanen, et al. *J. Clin. Invest.* 98, 1441-1448 (1996)). Most of the IL-6 is bound to antibody and therefore inactive. However, increased IL-6 levels can in some circumstances create safety issues since under some circumstances (such as in compartments with a low pH or high pH), and in certain tissues (like a filter that prevents Ab penetration but not IL-6) the IL-6 may separate from the antibody and the high level of active IL-6 could become a serious safety concern.

One alternative approach would be to use an inhibitor with a shorter serum halflife than antibodies, so that the increase in the total IL-6 concentration is less pronounced. The monomers and multimers of the present invention have human serum half lives of 60-180 hours (determined by allometric scaling from monkey data), much less than the 2-3 weeks halflife of many antibodies.

Thus, in some embodiments, IL-6 is inhibited in such a way that the IL-6-inhibitor complex is small enough to be cleared by the kidney. The kidney is a molecular size filter with a cut-off around 45-50 kD, letting only smaller molecules pass through. If the size of the cytokine-inhibitor complex can be kept under 35-40 kD, efficient kidney clearance is expected. Since most cytokines are around 18-20 kD in size, the inhibitor should less than 15-20 kD. The 18 kD IL-6 trimer multimers of the invention meet this requirement, but scaffold proteins based on Ig-domains, which are 3-fold larger, generally do not meet this requirement.

In another alternative, multimers of the invention can be designed that, when not bound to its target molecule (e.g., IL-6), have a hydrodynamic Stokes radius of a globular protein that will not be cleared by the kidney (e.g., greater than 45 kD, 50 kD, 55 kD), but, when bound to its target molecule (e.g., IL-6), have a hydrodynamic Stokes radius of a globular protein that will be cleared by the kidney (e.g., less than 55 kD, 50 kD, 45 kD or 40 kD). Such multimers will generally comprise at least 3, 4, 5, 6, 7, 8, or more monomer domains such that the multimers, when not bound to the target molecule, form a significantly larger Stokes radius than when bound to the target molecule. Such multimers can be readily selected by, for example, determining the sedimentation coefficient of 1) a globular protein too large to clear the kidney and 2) a globular protein small enough to clear the kidney and then selecting multimers that have a similar sedimentation coefficient to 1) in the absence of target molecule but that have a similar sedimentation coefficient to 2) in the presence of target molecule.

Alternatively, as discussed elsewhere herein, a multimer comprising a first monomer domain that binds to a half-life extender and a second monomer domain that binds to a portion of the ligand that does not bind to the ligand's receptor can be used to increase the half-life of the ligand.

In another embodiment, a multimer comprising a first monomer domain that binds to the ligand and a second monomer domain that binds to the receptor can be used to increase the effective affinity of the ligand for the receptor.

In another embodiment, multimers comprising at least two monomers that bind to receptors are used to bring two receptors into proximity by both binding the multimer, thereby activating the receptors.

Further examples of potential uses of the invention include monomer domains, and multimers thereof, that are capable of drug binding (e.g., binding radionucleotides for targeting, pharmaceutical binding for half-life extension of drugs, controlled substance binding for overdose treatment and addiction therapy), immune function modulating (e.g., immunogenicity blocking by binding such receptors as CTLA-4, immunogenicity enhancing by binding such receptors as CD80, or complement activation by Fc type binding), and specialized delivery (e.g., slow release by linker cleavage, electrotransport domains, dimerization domains, or specific binding to: cell entry domains, clearance receptors such as FcR, oral delivery receptors such as pIgR for trans-mucosal transport, and blood-brain transfer receptors such as transferrinR).

In further embodiments, monomers or multimers can be linked to a detectable label (e.g., Cy3, Cy5, etc.) or linked to a reporter gene product (e.g., CAT, luciferase, horseradish peroxidase, alkaline phosphotase, GFP, etc.).

IX. Further Manipulating Monomer Domains and/or Multimer Nucleic Acids and Polypeptides As mentioned above, the polypeptide of the present invention can be altered. Descriptions of a variety of diversity generating procedures for generating modified or altered nucleic acid sequences encoding these polypeptides are described herein and the references cited therein.

Another aspect of the present invention includes the cloning and expression of monomer domains, selected monomer domains, multimers and/or selected multimers coding nucleic acids. Thus, multimer domains can be synthesized as a single protein using expression systems well known in the art. General texts which describe molecular biological techniques useful herein, including the use of vectors, promoters and many other topics relevant to expressing nucleic acids such as monomer domains, selected monomer domains, multimers and/or selected multimers, include Berger and Kimmel, *Guide to Molecular Cloning Techniques, Methods in Enzymology* volume 152 Academic Press, Inc., San Diego, Calif. (Berger); Sambrook et al., *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in Molecular Biology*, F. M. Ausubel et al., eds., Current Protocols, a joint venture between Greene Publishing Associates, Inc. and John Wiley & Sons, Inc., (supplemented through 1999) ("Ausubel")). Examples of techniques sufficient to direct persons of skill through in vitro amplification methods, useful in identifying, isolating and cloning monomer domains and multimers coding nucleic acids, including the polymerase chain reaction (PCR) the ligase chain reaction (LCR), Q-replicase amplification and other RNA polymerase mediated techniques (e.g., NASBA), are found in Berger, Sambrook, and Ausubel, as well as Mullis et al., (1987) U.S. Pat. No. 4,683,202; *PCR Protocols A Guide to Methods and Applications* (Innis et al. eds) Academic Press Inc. San Diego, Calif. (1990) (Innis); Arnheim & Levinson (Oct. 1, 1990) *C&EN* 36-47; *The Journal Of NIH Research* (1991) 3, 81-94; (Kwoh et al. (1989) *Proc. Natl. Acad. Sci. USA* 86, 1173; Guatelli et al. (1990) *Proc. Natl. Acad. Sci. USA* 87, 1874; Lomell et al. (1989) *J. Clin. Chem.* 35, 1826; Landegren et al., (1988) *Science* 241, 1077-1080; Van Brunt (1990) *Biotechnology* 8, 291-294; Wu and Wallace, (1989) *Gene* 4, 560; Barringer et al. (1990) *Gene* 89, 117, and Sooknanan and Malek (1995) *Biotechnology* 13: 563-564. Improved methods of cloning in vitro amplified nucleic acids are described in Wallace et al., U.S. Pat. No. 5,426,039. Improved methods of amplifying large nucleic acids by PCR are summarized in Cheng et al. (1994) *Nature* 369: 684-685 and the references therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, Ausubel, Sambrook and Berger, all supra.

The present invention also relates to the introduction of vectors of the invention into host cells, and the production of monomer domains, selected monomer domains, multimers and/or selected multimers of the invention by recombinant techniques. Host cells are genetically engineered (i.e., transduced, transformed or transfected) with the vectors of this invention, which can be, for example, a cloning vector or an expression vector. The vector can be, for example, in the form of a plasmid, a viral particle, a phage, etc. Optionally, the vector may comprise one or more tag-encoding sequences, i.e., an oligonucleotide molecule located at the 5' and/or 3' end of the monomer and/or multimer coding sequence; the oligonucleotide sequence encodes polyHis (such as hexaHis (SEQ ID NO: 379)), or another tag such as HA (hemaglutinin influenza virus), for which commercially available antibodies exist. This tag is typically fused to the polypeptide upon expression of the polypeptide, and can serve as a means for purification of the polypeptide from the host cell. Optionally, the tag can subsequently be removed from the purified polypeptide by various means such as using certain peptidases for cleavage. Exemplary tag sequences include the following (SEQ ID NOS: 944-946):

MAGPAYPYDVPDYAPGLEASGGS;

KASGALEHHHHHHH;
and

HHHHHHH.

In addition to one or more tags, monomers and/or multimers of the present invention may comprise extra polypeptides that were fused to the monomer and/or multimer upon purification of the monomer and/or multimer. Such extra polypeptides may be present at the N-terminus, the C-terminus, or the N- and C-termini of the monomer and/or multimer. Exemplary sequences of extra polypeptides include the following (SEQ ID NOS: 947-948):

MKHSGGS;

KASGALE;
and

SLQ.

The engineered host cells can be cultured in conventional nutrient media modified as appropriate for activating promoters, selecting transformants, or amplifying the monomer domain, selected monomer domain, multimer and/or selected multimer gene(s) of interest. The culture conditions, such as temperature, pH and the like, are those previously used with the host cell selected for expression, and will be apparent to those skilled in the art and in the references cited herein, including, e.g., Freshney (1994) *Culture of Animal Cells, a Manual of Basic Technique*, third edition, Wiley-Liss, New York and the references cited therein.

As mentioned above, the polypeptides of the invention can also be produced in non-animal cells such as plants, yeast, fungi, bacteria and the like. Indeed, as noted throughout, phage display is an especially relevant technique for producing such polypeptides. In addition to Sambrook, Berger and Ausubel, details regarding cell culture can be found in Payne et al. (1992) *Plant Cell and Tissue Culture in Liquid Systems* John Wiley & Sons, Inc. New York, N.Y.; Gamborg and Phillips (eds) (1995) *Plant Cell, Tissue and Organ Culture*; Fundamental Methods Springer Lab Manual, Springer-Verlag (Berlin Heidelberg New York) and Atlas and Parks (eds) *The Handbook of Microbiological Media* (1993) CRC Press, Boca Raton, Fla.

The present invention also includes alterations of monomer domains, immuno-domains and/or multimers to improve pharmacological properties, to reduce immunogenicity, or to facilitate the transport of the multimer and/or monomer domain into a cell or tissue (e.g., through the blood-brain barrier, or through the skin). These types of alterations include a variety of modifications (e.g., the addition of sugar-groups or glycosylation), the addition of PEG, the addition of protein domains that bind a certain protein (e.g., HSA or other serum protein), the addition of proteins fragments or sequences that signal movement or transport into, out of and through a cell. Additional components can also be added to a multimer and/or monomer domain to manipulate the properties of the multimer and/or monomer domain. A variety of components can also be added including, e.g., a domain that binds a known receptor (e.g., a Fc-region protein domain that binds a Fc receptor), a toxin(s) or part of a toxin, a prodomain that can be optionally cleaved off to activate the multimer or monomer domain, a reporter molecule (e.g., green fluorescent protein), a component that bind a reporter molecule (such as a radionuclide for radiotherapy, biotin or avidin) or a combination of modifications.

X. Animal Models

Another aspect of the invention is the development of specific non-human animal models in which to test the immunogenicity of the monomer or multimer domains. The method of producing such non-human animal model comprises: introducing into at least some cells of a recipient non-human animal, vectors comprising genes encoding a plurality of human proteins from the same family of proteins, wherein the genes are each operably linked to a promoter that is functional in at least some of the cells into which the vectors are introduced such that a genetically modified non-human animal is obtained that can express the plurality of human proteins from the same family of proteins.

Suitable non-human animals employed in the practice of the present invention include all vertebrate animals, except humans (e.g., mouse, rat, rabbit, sheep, and the like). Typically, the plurality of members of a family of proteins includes at least two members of that family, and usually at least ten family members. In some embodiments, the plurality includes all known members of the family of proteins. Exemplary genes that can be used include those encoding monomer domains, such as, for example, members of the LDL receptor class A-domain family, the EGF-like domain family, as well as the other domain families described herein.

The non-human animal models of the present invention can be used to screen for immunogenicity of a monomer or multimer domain that is derived from the same family of proteins expressed by the non-human animal model. The present invention includes the non-human animal model made in accordance with the method described above, as well as transgenic non-human animals whose somatic and germ cells contain and express DNA molecules encoding a plurality of human proteins from the same family of proteins (such as the monomer domains described herein), wherein the DNA molecules have been introduced into the transgenic non-human animal at an embryonic stage, and wherein the DNA molecules are each operably linked to a promoter in at least some of the cells in which the DNA molecules have been introduced.

An example of a mouse model useful for screening LDL receptor class A-domain derived binding proteins is described as follows. Gene clusters encoding the wild type human LDL receptor class A-domain monomers are amplified from human cells using PCR. Almost all of the 200 different A-domains can be amplified with only three separate PCR amplification reactions of about 7 kb each. These fragments are then used to generate transgenic mice according to the method described above. The transgenic mice will recognize the human A-domains as "self", thus mimicking the "selfness" of a human with regard to A-domains. Individual A-domain-derived monomers or multimers are tested in these mice by injecting the A-domain-derived monomers or multimers into the mice, then analyzing the immune response (or lack of response) generated. The mice are tested to determine if they have developed a mouse anti-human response (MAHR). Monomers and multimers that do not result in the generation of a MAHR are likely to be non-immunogenic when administered to humans.

Historically, MAHR test in transgenic mice is used to test individual proteins in mice that are transgenic for that single protein. In contrast, the above described method provides a non-human animal model that recognizes an entire family of human proteins as "self," and that can be used to evaluate a huge number of variant proteins that each are capable of vastly varied binding activities and uses.

XI. Kits

Kits comprising the components needed in the methods (typically in an unmixed form) and kit components (packaging materials, instructions for using the components and/or the methods, one or more containers (reaction tubes, columns, etc.)) for holding the components are a feature of the present invention. Kits of the present invention may contain a multimer library, or a single type of monomer or multimer, e.g., polypeptides comprising the IL-6 and/or IgG binding domains described herein. Kits can also include reagents suitable for promoting target molecule binding, such as buffers or reagents that facilitate detection, including detectably-labeled molecules. Standards for calibrating a ligand binding to a monomer domain or the like, can also be included in the kits of the invention. In some aspects, kits may include reagents suitable for adjusting the half-life of individual multimers for its specific indication.

The present invention also provides commercially valuable binding assays and kits to practice the assays. In some of the assays of the invention, one or more ligand is employed to detect binding of a monomer domain, immuno-domains and/or multimer. Such assays are based on any known method in the art, e.g., flow cytometry, fluorescent microscopy, plasmon resonance, and the like, to detect binding of a ligand(s) to the monomer domain and/or multimer.

Kits based on the assay are also provided. The kits typically include a container, and one or more ligand. The kits optionally comprise directions for performing the assays, additional detection reagents, buffers, or instructions for the use of any of these components, or the like. Alternatively, kits can include cells, vectors, (e.g., expression vectors, secretion vectors comprising a polypeptide of the invention), for the expression of a monomer domain and/or a multimer of the invention.

In a further aspect, the present invention provides for the use of any composition, monomer domain, immuno-domain, multimer, cell, cell culture, apparatus, apparatus component or kit herein, for the practice of any method or assay herein, and/or for the use of any apparatus or kit to practice any assay or method herein and/or for the use of cells, cell cultures, compositions or other features herein as a therapeutic formulation. The manufacture of all components herein as therapeutic formulations for the treatments described herein is also provided.

XII. Integrated Systems

The present invention provides computers, computer readable media and integrated systems comprising character strings corresponding to monomer domains, selected monomer domains, multimers and/or selected multimers and nucleic acids encoding such polypeptides. These sequences can be manipulated by in silico recombination methods, or by standard sequence alignment or word processing software.

For example, different types of similarity and considerations of various stringency and character string length can be detected and recognized in the integrated systems herein. For example, many homology determination methods have been designed for comparative analysis of sequences of biopolymers, for spell checking in word processing, and for data retrieval from various databases. With an understanding of double-helix pair-wise complement interactions among 4 principal nucleobases in natural polynucleotides, models that simulate annealing of complementary homologous polynucleotide strings can also be used as a foundation of sequence alignment or other operations typically performed on the character strings corresponding to the sequences herein (e.g., word-processing manipulations, construction of figures comprising sequence or subsequence character strings, output tables, etc.). An example of a software package with GOs for calculating sequence similarity is BLAST, which can be adapted to the present invention by inputting character strings corresponding to the sequences herein.

BLAST is described in Altschul et al., (1990) *J. Mol. Biol.* 215:403-410. Software for performing BLAST analyses is publicly available through the National Center for Biotechnology Information (available on the World Wide Web at ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=-4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915).

An additional example of a useful sequence alignment algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, (1987) *J. Mol. Evol.* 35:351-360. The method used is similar to the method described by Higgins & Sharp, (1989) *CABIOS* 5:151-153. The program can align, e.g., up to 300 sequences of a maximum length of 5,000 letters. The multiple alignment procedure begins with the pairwise alignment of the two most similar sequences, producing a cluster of two aligned sequences. This cluster can then be aligned to the next most related sequence or cluster of aligned sequences. Two clusters of sequences can be aligned by a simple extension of the pairwise alignment of two individual sequences. The final alignment is achieved by a series of progressive, pairwise alignments. The program can also be used to plot a dendogram or tree representation of clustering relationships. The program is run by designating specific sequences and their amino acid or nucleotide coordinates for regions of sequence comparison. For example, in order to determine conserved amino acids in a monomer domain family or to compare the sequences of monomer domains in a family, the sequence of the invention, or coding nucleic acids, are aligned to provide structure-function information.

In one aspect, the computer system is used to perform "in silico" sequence recombination or shuffling of character strings corresponding to the monomer domains. A variety of such methods are set forth in "Methods For Making Character Strings, Polynucleotides & Polypeptides Having Desired Characteristics" by Selifonov and Stemmer, filed Feb. 5, 1999 (U.S. Ser. No. 60/118,854) and "Methods For Making Character Strings, Polynucleotides & Polypeptides Having Desired Characteristics" by Selifonov and Stemmer, filed Oct. 12, 1999 (U.S. Ser. No. 09/416,375). In brief, genetic operators are used in genetic algorithms to change given sequences, e.g., by mimicking genetic events such as mutation, recombination, death and the like. Multi-dimensional analysis to optimize sequences can be also be performed in the computer system, e.g., as described in the '375 application.

A digital system can also instruct an oligonucleotide synthesizer to synthesize oligonucleotides, e.g., used for gene reconstruction or recombination, or to order oligonucleotides from commercial sources (e.g., by printing appropriate order forms or by linking to an order form on the Internet).

The digital system can also include output elements for controlling nucleic acid synthesis (e.g., based upon a sequence or an alignment of a recombinant, e.g., recombined, monomer domain as herein), i.e., an integrated system of the invention optionally includes an oligonucleotide synthesizer or an oligonucleotide synthesis controller. The system can include other operations that occur downstream from an alignment or other operation performed using a character string corresponding to a sequence herein, e.g., as noted above with reference to assays.

EXAMPLES

The following example is offered to illustrate, but not to limit the claimed invention.

Example 1

This example describes selection of monomer domains and the creation of multimers.

Starting materials for identifying monomer domains and creating multimers from the selected monomer domains and procedures can be derived from any of a variety of human and/or non-human sequences. For example, to produce a selected monomer domain with specific binding for a desired ligand or mixture of ligands, one or more monomer domain gene(s) are selected from a family of monomer domains that bind to a certain ligand. The nucleic acid sequences encoding the one or more monomer domain gene can be obtained by PCR amplification of genomic DNA or cDNA, or optionally, can be produced synthetically using overlapping oligonucleotides.

Most commonly, these sequences are then cloned into a cell surface display format (i.e., bacterial, yeast, or mammalian (COS) cell surface display; phage display) for expression and screening. The recombinant sequences are transfected (transduced or transformed) into the appropriate host cell where they are expressed and displayed on the cell surface. For example, the cells can be stained with a labeled (e.g., fluorescently labeled), desired ligand. The stained cells are sorted by flow cytometry, and the selected monomer domains encoding genes are recovered (e.g., by plasmid isolation, PCR or expansion and cloning) from the positive cells. The process of staining and sorting can be repeated multiple times (e.g., using progressively decreasing concentrations of the desired ligand until a desired level of enrichment is obtained). Alternatively, any screening or detection method known in the art that can be used to identify cells that bind the desired ligand or mixture of ligands can be employed.

The selected monomer domain encoding genes recovered from the desired ligand or mixture of ligands binding cells can be optionally recombined according to any of the methods described herein or in the cited references. The recombinant sequences produced in this round of diversification are then screened by the same or a different method to identify recombinant genes with improved affinity for the desired or target ligand. The diversification and selection process is optionally repeated until a desired affinity is obtained.

The selected monomer domain nucleic acids selected by the methods can be joined together via a linker sequence to create multimers, e.g., by the combinatorial assembly of nucleic acid sequences encoding selected monomer domains by DNA ligation, or optionally, PCR-based, self-priming overlap reactions. The nucleic acid sequences encoding the multimers are then cloned into a cell surface display format (i.e., bacterial, yeast, or mammalian (COS) cell surface display; phage display) for expression and screening. The recombinant sequences are transfected (transduced or transformed) into the appropriate host cell where they are expressed and displayed on the cell surface. For example, the cells can be stained with a labeled, e.g., fluorescently labeled, desired ligand or mixture of ligands. The stained cells are sorted by flow cytometry, and the selected multimers encoding genes are recovered (e.g., by PCR or expansion and cloning) from the positive cells. Positive cells include multimers with an improved avidity or affinity or altered specificity to the desired ligand or mixture of ligands compared to the selected monomer domain(s). The process of staining and sorting can be repeated multiple times (e.g., using progressively decreasing concentrations of the desired ligand or mixture of ligands until a desired level of enrichment is obtained). Alternatively, any screening or detection method known in the art that can be used to identify cells that bind the desired ligand or mixture of ligands can be employed.

The selected multimer encoding genes recovered from the desired ligand or mixture of ligands binding cells can be optionally recombined according to any of the methods described herein or in the cited references. The recombinant sequences produced in this round of diversification are then screened by the same or a different method to identify recombinant genes with improved avidity or affinity or altered specificity for the desired or target ligand. The diversification and selection process is optionally repeated until a desired avidity or affinity or altered specificity is obtained.

Example 2

This example describes in vivo intra-protein recombination to generate libraries of greater diversity.

A monomer-encoding plasmid vector (pCK-derived vector; see below), flanked by orthologous loxP sites, was recombined in a Cre-dependent manner with a phage vector via its compatible loxP sites. The recombinant phage vectors were detected by PCR using primers specific for the recombinant construct. DNA sequencing indicated that the correct recombinant product was generated.

Reagents and Experimental Procedures pCK-cre-lox-Monomer-loxP. This vector has two particularly relevant features. First, it carries the cre gene, encoding the site-specific DNA recombinase Cre, under the control of $P_{lac}$. Cre was PCR-amplified from p705-cre (from Gene-Bridges) with cre-specific primers that incorporated XbaI (5') and SfiI (3') at the ends of the PCR product. This product was digested with XbaI and SfiI and cloned into the identical sites of pCK, a bla⁻, $Cm^R$ derivative of pCK 110919-HC-Bla (pA-CYC ori), yielding pCK-cre.

The second feature is the naïve A domain library flanked by two orthologous loxP sites, loxP(wild-type) and loxP(FAS), which are required for the site-specific DNA recombination catalyzed by Cre. See, e.g., Siegel, R. W., et al. FEBS Letters 505:467-473 (2001). These sites rarely recombine with another. loxP sites were built into pCK-cre sequentially. 5'-phosphorylated oligonucleotides loxP(K) and loxP(K_rc), carrying loxP(WT) and EcoRI and HinDIII-compatible overhangs to allow ligation to digested EcoRI and HinDIII-digested pCK, were hybridized together and ligated to pCK-cre in a standard ligation reaction (T4 ligase; overnight at 16 C).

The resulting plasmid was digested with EcoRI and SphI and ligated to the hybridized, 5'-phosphorylated oligos loxP (L) and loxP(L_rc), which carry loxP(FAS) and EcoRI and SphI-compatible overhangs. To prepare for library construction, a large-scale purification (Qiagen MAXI prep) of pCK-cre-lox-P(wt)-loxP(FAS) was performed according to Qiagen's protocol. The Qiagen-purified plasmid was subjected to CsCl gradient centrifugation for further purification. This construct was then digested with SphI and BglII and ligated to digested naïve A domain library insert, which was obtained via a PCR-amplification of a preexisting A domain library pool. By design, the loxP sites and monomer are in-frame, which generates monomers with loxP-encoded linkers. This library was utilized in the in vivo recombination procedure as detailed below.

fUSE5HA-Monomer-lox-lox vector. The vector is a derivative of fUSE5 from George Smith's laboratory (University of Missouri). It was subsequently modified to carry an HA tag for immunodetection assays. loxP sites were built into fUSE5HA sequentially. 5'-phosphorylated oligonucleotides loxP(I) and loxP(I)_rc, carrying loxP(WT), a string of stop codons and XmaI and SfiI-compatible overhangs, were hybridized together and ligated to XmaI- and SfiI-digested fUSE5HA in a standard ligation reaction (New England Biolabs T4 ligase; overnight at 16 C).

The resulting phage vector was next digested with XmaI and SphI and ligated to the hybridized oligos loxP(J) and loxP(J)_rc, which carry loxP(FAS) and overhangs compatible with XmaI and SphI. This construct was digested with XmaI/SfiI and then ligated to pre-cut (XmaI/SfiI) naïve A domain library insert (PCR product). The stop codons are located between the loxP sites, preventing expression of gIII and consequently, the production of infectious phage.

The ligated vector/library was subsequently transformed into an *E. coli* host bearing a gIII-expressing plasmid that allows the rescue of the fUSE5HA-Monomer-lox-lox phage, as detailed below.

pCK-gIII. This plasmid carries gIII under the control of its native promoter. It was constructed by PCR-amplifying gIII and its promoter from VCSM 13 helper phage (Stratagene) with primers gIIIPromoter_EcoRI and gIIIPromoter_HinDIII. This product was digested with EcoRI and HinDIII and cloned into the same sites of pCK110919-HC-Bla. As gIII is under the control of its own promoter, gIII expression is presumably constitutive. pCK-gIII was transformed into *E. coli* EC100 (Epicentre).

In vivo recombination procedure. In summary, the procedure involves the following key steps: a) Production of infective (i.e. rescue) of fUSE5HA-Monomer-lox-lox library with an *E. coli* host expressing gIII from a plasmid; b) Cloning of $2^{nd}$ library (pCK) and transformation into F⁺ TG1 *E. coli*; c) Infection of the culture carrying the $2^{nd}$ library with the rescued fUSE5HA-Monomer-lox-lox phage library.

a. Rescue of phage vector. Electrocompetent cells carrying pCK-gIII were prepared by a standard protocol. These cells had a transformation frequency of $4 \times 10^8$/µg DNA and were electroporated with large-scale ligations (~5 µg vector DNA) of fUSE5HA-lox-lox vector and the naïve A domain library insert. After individual electroporations (100 ng DNA/electroporation) with ~70 μL cells/cuvette, 930 μL warm SOC media were added, and the cells were allowed to recover with shaking at 37 C for 1 hour. Next, tetracycline was added to a final concentration of 0.2 μg/mL, and the cells were shaken for ~45 minutes at 37 C. An aliquot of this culture was removed, 10-fold serially diluted and plated to determine the resulting library size ($1.8 \times 10^7$). The remaining culture was diluted into 2×500 mL 2×YT (with 20 μg/mL chloramphenicol and 20 μg/mL tetracycline to select for pCK-gIII and the fUSE5HA-based vector, respectively) and grown overnight at 30 C.

Rescued phage were harvested using a standard PEG/NaCl precipitation protocol. The titer was approximately $1 \times 10^{12}$ transducing units/mL.

b. Cloning of the $2^{nd}$ library and transformation into an *E. coli* host. The ligated pCK/naïve A domain library is electroporated into a bacterial F+ host, with an expected library size of approximately $10^8$. After an hour-long recovery period at 37 C with shaking, the electroporated cells are diluted to $OD_{600}$~0.05 in 2×YT (plus 20 μg/mL chloramphenicol) and grown to mid-log phase at 37 C before infection by fUSEHA-Monomer-lox-lox.

c. Infection of the culture carrying the $2^{nd}$ library with the rescued fUSE5HA-Monomer-lox-lox phage library. To maximize the generation of recombinants, a high infection rate (>50%) of *E. coli* within a culture is desirable. The infectivity of *E. coli* depends on a number of factors, including the expression of the F pilus and growth conditions. *E. coli* backgrounds TG1 (carrying an F') and K91 (an Hfr strain) were hosts for the recombination system.

```
Oligonucleotides
                                                          (SEQ ID NO: 380)
loxP(K)
[P-5' agcttataacttcgtatagaaaggtatatacgaagttatagatctcgtgctgcatgcggtgcg]

(SEQ ID NO: 381)
loxP(K_rc)
[P-5' aattcgcaccgcatgcagcacgagatctataacttcgtatataccttctatacgaagttataagct]

loxP(L)
                                                          (SEQ ID NO: 382)
[P-5' ataacttcgtatagcatacattatacgaagttatcgag]

loxP (L_rc)
                                                          (SEQ ID NO: 383)
[P-5' ctcgataacttcgtataatgtatgctatacgaagttatg]

loxP(I)
                                                          (SEQ ID NO: 384)
[P5' ccgggagcagggcatgctaagtgagtaataagtgagtaaataacttcgtatataccttctatacgaagttatcgtctg]

loxP(I)_rc
                                                          (SEQ ID NO: 385)
[P-5' acgataacttcgtatagaaaggtatatacgaagttatttactcacttattactcacttagcatgccctgctc]

loxP(J)
                                                          (SEQ ID NO: 386)
[5' ccgggaccagtggcctctggggccataacttcgtatagcatacattatacgaagttatg]

loxP(J)_rc
                                                          (SEQ ID NO: 387)
[5' cataacttcgtataatgtatgctatacgaagttatggccccagaggccactggtc]

gIIIPromoter_EcoRI
                                                          (SEQ ID NO: 388)
[5' atggcgaattctcattgtcggcgcaactat gIIIPromoter_HinDIII
                                                          (SEQ ID NO: 389)
[5' gataagctttcattaagactccttattacgcag]
```

Example 3

This example describes construction of an EGF-based monomer library.

The CaEGF domain library, E3, encodes a protein domain of 36-43 amino acids having the following pattern:

(SEQ ID NO: 390)
$X_{(5)}C_1-X_{(4/6)}-C_2-X_{(4,5)}-C_3-X_{(8)}-C_4-X_{(1)}-C_5-X_{(8/12)}-C_6$

The table below (SEQ ID NOS: 390 (general sequence) and 391-420 (preferred embodiments)) describes for each position which amino acids are encoded in the library based upon the natural diversity of human calcium binding EGF domains:

Variable position residues

X(5):

| X1 | X2 | X3 | X4 | X5 |
|----|----|----|----|----|
| V | D | V | N | E |
| T | | | | D |
| I | | | | |
| K | | | | |
| E | | | | |
| A | | | | |

C1

X(4,6):

| X1 | X2 | X3 | X4 | X5 | X6 |
|----|----|----|----|----|----|
| V | S | S | P | A | A |
| S | P | G | A | D | I |
| L | E | N | S | G | L |
| A | Q | S | G | H | P |
| D | I | G | I | L | |
| E | V | N | H | N | |
| G | N | P | N | P | |
| K | | I | P | S | |
| N | | V | | V | |
| R | | | | | |
| T | | | | | |

C2

X(4,5):

| X1 | X2 | X3 | X4 | X5 |
|----|----|----|----|----|
| V | S | G | S | I |
| T | R | D | R | K |
| S | N | N | Q | N |
| R | N | N | N | R |
| Q | H | S | Q | S |
| P | P | | L | T |
| N | | | R | |
| M | | | K | |
| L | | | S | |
| K | | | I | |
| I | | | H | |
| M | | | A | |
| G | | | G | |
| E | | | | |
| D | | | | |
| A | | | | |

C3

X(8):

| X1 | X2 | X3 | X4 | X5 | X6 | X7 | X8 |
|----|----|----|----|----|----|----|----|
| V | N | T | V | G | S | T | S |
| Q | D | S | Q | S | G | F | R |
| L | L | P | | Q | | G | Q |
| K | I | | | L | | R | K |
| I | | | | P | | Q | H |
| E | | | | I | | K | |
| | | | | L | | H | |
| | | | | E | | | |
| | | | | A | | | |

C4

X:

| X1 |
|----|
| V |
| S |
| R |
| Q |
| N |
| M |
| L |
| K |
| I |
| H |
| G |
| E |
| D |

C5

X(8,12):

| X1 | X2 | X3 | X4 | X5 | X6 | X7 | X8 | X9 | X10 | X11 | X12 |
|----|----|----|----|----|----|----|----|----|-----|-----|-----|
| V | Q | G | Y | F | S | L | T | R | A | G | K | 
| P | P | | F | S | L | T | R | A | G | K | A |
| L | E | | S | A | P | Q | N | D | R | N | D |
| A | A | | A | P | Q | N | D | R | N | R | E |
| H | K | | E | Q | P | L | N | S | R | E | G |
| N | T | | L | K | R | L | I | T | S | T | K |
| R | S | | M | L | K | H | I | A | T | | N |
| S | | | P | M | I | A | E | E | | | R |
| T | | | Q | P | E | E | A | G | | | S |
| | | | V | Q | A | G | D | P | | | T |
| | | | | V | D | P | | | | | |
| | | | | | G | Q | | | | | |
| | | | | | N | S | | | | | |
| | | | | | S | | | | | | |

C6

The library of DNA sequences, E3, encoding monomeric calcium binding EGF domains, was created by assembly PCR as described in Stemmer et al., Gene 164:49-53 (1995). The oligonucleotides used in this PCR reaction are in two groups, 1 and 2. They are:

```
Group 1 (SEQ ID NOS: 421-426):
1. 5'-AAAAGGCCTCGAGGGCCTGGGTGGCAATGGT-3'

2. 5'-CCTGAACCACCACAKHKACCGYKSNBGCACGGAYYCGRCRMACA
   TTCATYAAYATCTDYACCATTGCCACCC-3'

3. 5'-CCTGAACCACCACAKNTGSCGYYGYKMHSGCACGGAYYCGRCRM
   ACATTCATYAAYATCTDYACCATTGCCACCC-3'

4. 5'-CCTGAACCACCACAKHKACCGYKSNBGCAARBAYBCGVAHYCWS
   KBYACATTCATYAAYATCTDYACCATTGCCACCC-3'

5. 5'-CCTGAACCACCACAKNTGSCGYYGYKMHSGCAARBAYBCGVAHY
   CWSKBYACATTCATYAAYATCTDYACCATTGCCACCC-3'

6. 5'-TGAATTTTCTGTATGAGGTTTTGCTAAACAACTTTCAACAGTTT
   CGGCCCCAGAGGCCCTGGAGCCACCTGAACCACCACA-3'

Group 2 (SEQ ID NOS: 427-430):
1. 5'-ACGGTGCCTACCCGTATGATGTTCCGGATTATGCCCCGGGTGGC
   AATG GT-3'

2. 5'-CCTGAACCACCACAGHKTDBACCGGHAWAGCCTKSCRSGCASHB
   ACAKYKAWAGCYACCCDSTRWATYTWBACCATTGCCACCC-3'

3. 5'-CCTGAACCACCACAKBYKBTKCYGKYCBSABYCNGCDBAWAGCC
   TKBGBKGCASHBACAKYKAWAGCYACCCDSTRWATYTWBACCATTGC
   CACCC-3'

4. 5'-AAAAGCCCCAGAGGCCCCTGAACCACCACA-3'
where R = A/G, Y = C/T, M = A/C, K = G/T, S = C/G,
W = A/T, B = C/G/T, D = A/G/T, H = A/C/T,
V = A/C/G, and N = A/C/G/T.
```

Following the separate PCRs of the Group 1 and 2 oligonucleotides, the Group 1 PCR fragments were digested with BpmI and group 2 PCR fragments were digested with BsrDI. Digestion products were purified using Qiagen Qiaquick columns and then ligated together. The ligated DNA was then amplified in a PCR using two primers. These are:

```
                                          (SEQ ID NO: 431)
5'-AAAAGGCCTCGAGGGCCTGGGTGGCAATGGT-3'

(SEQ ID NO: 432)
5'-AAAAGGCCCCAGAGGCCCCTGAACCACCACA-3'
```

The PCR products were purified with Qiagen Qiaquick columns and digested with SfiI. The digested product was purified with Qiagen Qiaquick columns. The DNA fragments were ligated into the SfiI restriction sites of phage display vector fuse5-HA(G4S)4, a derivative of fuse5 carrying an in-frame HA-epitope and a glycine, serine flexible linker. The ligation mixture was electroporated into TransforMax™ EC100™ electrocompetent *E. coli* cells. Transformed *E. coli* cells were grown overnight at 37° C. in 2×YT medium containing 20 µg/ml tetracycline. The resulting library contained $2 \times 10^9$ independent clones. Phage particles were purified from the culture medium by PEG-precipitation. The titer of the phage was $1.3 \times 10^{12}$/ml. The sequences of 24 individual clones were determined and these were consistent with the library design.

Example 4

This example describes construction of an EGF-based monomer library.

Recombination can be used for intradomain optimization. For example a PCR overlap reaction can be used that recombines two or more segments of a single domain relative to each other. One can use two, three, four, five or more fragment overlap reactions in the same way as illustrated. This recombination process has many applications. One application is to recombine a large pool of hundreds of previously selected clones without sequence information. All that is needed for each overlap to work is one known region of (relatively) constant sequence that exists in the same location in each of the clones (fixed site approach). For A domains, typically these clones would have been derived from a library in which 20-25 amino acids distributed over all five inter-cysteine segments were randomized. The intra-domain recombination method can also be performed on a pool of sequence-related monomer domains by standard DNA recombination (e.g., Stemmer, Nature 370:389-391 (1994)) based on random fragmentation and reassembly based on DNA sequence homology, which does not require a fixed overlap site in all of the clones that are to be recombined.

Another application of this process is to create multiple separate, naïve (meaning unpanned) libraries in each of which only one of the intercysteine loops is randomized, to randomize a different loop in each library. After panning of these libraries separately against the target, the selected clones are then recombined. From each panned library only the randomized segment is amplified by PCR and multiple randomized segments are then combined into a single domain, creating a shuffled library which is panned and/or screened for increased potency. This process can also be used to shuffle a small number of clones of known sequence.

Any common sequence may be used as cross-over points. For A domains or other cysteine-containing monomers, the cysteine residues are logical places for the crossover. However, there are other ways to determine optimal crossover sites, such as computer modeling. Alternatively, residues with highest entropy, or the least number of intramolecular contacts, may also be good sites for crossovers.

An exemplary method of generating libraries comprised of proteins with randomized inter-cysteine loops is presented below. In this example, in contrast to the separate loop, separate library approach described above, multiple intercysteine loops are randomized simultaneously in the same library.

An A domain NNK library encoding a protein domain of 39-45 amino acids having the following pattern was constructed:

C1-X(4,6)-E1-F-R1-C2-A-X(2,4)-G1-R2-C3-I-P-S1-S2-W-V-C4-D1-G2-E2-D2-D3-C5-G3-D4-G4-S3-D5-E3-X(4,6)-C6 (SEQ ID NOS: 949 (general sequence) and 433-459 (preferred embodiments));

where,

C1-C6: cysteines;

X(n): sequence of n amino acids with any residue at each position;

E1-E3: glutamine;

F: phenylalanine;

R1-R2: arginine;

A: alanine;

G1-G4: glycine;

I: isoleucine;

P: proline;

S1-S3: serine;

W: tryptophan;

V: valine;

D1-D5: aspartic acid; and

C1-C3, C2-C5 & C4-C6 form disulfides.

The library was constructed by creating a library of DNA sequences, containing tyrosine codons (TAT) or variable non-conserved codons (NNK), by assembly PCR as described in Stemmer et al., *Gene* 164:49-53 (1995). Compared to the native A-domain scaffold and the design that was used to construct library A1 (described previously) this approach: 1) keeps more of the existing residues in place instead of randomizing these potentially critical residues, and 2) inserts a string of amino acids of variable length of all 20 amino acids (NNK codon), such that the average number of inter-cysteine residues is extended beyond that of the natural A domain or the A1 library. The rate of tyrosine residues was increased by including tyrosine codons in the oligonucleotides, because tyrosines were found to be overrepresented in antibody binding sites, presumably because of the large number of different contacts that tyrosine can make. The oligonucleotides used in this PCR reaction are (SEQ ID NOS:460-486):

```
 1. 5'-ATATCCCGGGTCTGGAGGCGTCTGGTGGTTCGTGTNNKNNKNNKNNKGAATTCCGA-3'

2. 5'-ATATCCCGGGTCTGGAGGCGTCTGGTGGTTCGTGTNNKNNKNNKNNKNNKGAATTCCGA-3'

3. 5'-ATATCCCGGGTCTGGAGGCGTCTGGTGGTTCGTGTNNKNNKNNKNNKNNKNNKGAATTCCGA-3'

4. 5'-ATATCCCGGGTCTGGAGGCGTCTGGTGGTTCGTGTTATNNKNNKNNKGAATTCCGA-3'

5. 5'-ATATCCCGGGTCTGGAGGCGTCTGGTGGTTCGTGTNNKTATNNKNNKNNKGAATTCCGA-3'

6. 5'-ATATCCCGGGTCTGGAGGCGTCTGGTGGTTCGTGTNNKTATNNKNNKGAATTCCGA-3'

7. 5'-ATATCCCGGGTCTGGAGGCGTCTGGTGGTTCGTGTNNKNNKTATNNKGAATTCCGA-3'

8. 5'-ATATCCCGGGTCTGGAGGCGTCTGGTGGTTCGTGTNNKNNKNNKTATGAATTCCGA-3'

9. 5'-ATATCCCGGGTCTGGAGGCGTCTGGTGGTTCGTGTNNKNNKNNKTATNNKGAATTCCGA-3'

10. 5'-ATACCCAAGAAGACGGTATACATCGTCCMNNMNNTGCACATCGGAATTC-3'

11. 5'-ATACCCAAGAAGACGGTATACATCGTCCMNNMNNMNNTGCACATCGGAATTC-3'

12. 5'-ATACCCAAGAAGACGGTATACATCGTCCMNNMNNMNNMNNTGCACATCGGAATTC-3'

13. 5'-ATACCCAAGAAGACGGTATACATCGTCCATAMNNMNNTGCACATCGGAATTC-3'

14. 5'-ATACCCAAGAAGACGGTATACATCGTCCMNNATAMNNMNNTGCACATCGGAATTC-3'

15. 5'-ATACCCAAGAAGACGGTATACATCGTCCMNNATAMNNTGCACATCGGAATTC-3'

16. 5'-ATACCCAAGAAGACGGTATACATCGTCCMNNMNNATATGCACATCGGAATTC-3'

17. 5'-ATACCCAAGAAGACGGTATACATCGTCCMNNMNNATAMNNTGCACATCGGAATTC-3'

18. 5'-ACCGTCTTCTTGGGTATGTGACGGGGAGGACGATTGTGGTGACGGATCTGACGAG-3'

19. 5'-ATATGGCCCCAGAGGCCTGCAATGATCCACCGCCCCCACAMNNMNNMNNMNNCTCGTCAG
        ATCCGT-3'

20. 5'-ATATGGCCCCAGAGGCCTGCAATGATCCACCGCCCCCACAMNNMNNMNNMNNMNNCTCGTCA
        GATCCGT-3'

21. 5'-ATATGGCCCCAGAGGCCTGCAATGATCCACCGCCCCCACAMNNMNNMNNMNNMNNMNNC
        TCGTCAGATCCGT-3'

22. 5'-ATATGGCCCCAGAGGCCTGCAATGATCCACCGCCCCCACAATAMNNMNNMNNCTCGTC
        AGATCCGT-3'

23. 5'-ATATGGCCCCAGAGGCCTGCAATGATCCACCGCCCCCACAMNNATAMNNMNNMNNCT
        CGTCAGATCCGT-3'

24. 5'-ATATGGCCCCAGAGGCCTGCAATGATCCACCGCCCCCACAMNNATAMNNMNNCTCGT
        CAGATCCGT-3'

25. 5'-ATATGGCCCCAGAGGCCTGCAATGATCCACCGCCCCCACAMNNMNNATAMNNCTCG
        TCAGATCCGT-3'

26. 5'-ATATGGCCCCAGAGGCCTGCAATGATCCACCGCCCCCACAMNNMNNMNNATACTCG
        TCAGATCCGT-3'
```

-continued

```
27.5' -
    ATATGGCCCCAGAGGCCTGCAATGATCCACCGCCCCCACAMNNMNNMNNATAMNNCTCGTCAGATCCGT- 3'
``` where R = A/G, Y = C/T, M = A/C, K = G/T, S = C/G, W = A/T, B = C/G/T,

D = A/G/T, H = A/C/T, V = A/C/G, and N = A/C/G/T

The library was constructed though an initial round of 10 cycles of PCR amplification using a mixture of 4 pools of oligonucleotides, each pool containing 400 pmols of DNA. Pool 1 contained oligonucleotides 1-9, pool 2 contained 10-17, pool 3 contained only 18 and pool 4 contained 19-27. The fully assembled library was obtained through an additional 8 cycles of PCR using pool 1 and 4. The library fragments were digested with XmaI and SfiI. The DNA fragments were ligated into the corresponding restriction sites of phage display vector fuse5-HA, a derivative of fuse5 carrying an in-frame HA-epitope. The ligation mixture was electroporated into TransforMax™ EC100™ electrocompetent *E. coli* cells resulting in a library of 2×10$^9$ individual clones. Transformed *E. coli* cells were grown overnight at 37° C. in 2×YT medium containing 20 μg/ml tetracycline. Phage particles were purified from the culture medium by PEG-precipitation and a titer of 1.1×10$^{13}$/ml was determined. Sequences of 24 clones were determined and were consistent with the expectations of the library design.

Example 5

This example describes optimization of multimers by optimizing monomers and/or linkers for binding to a target.

One approach for optimizing multimer binding to targets involves optimization of monomers, multimers and linkers. First a library of monomers is panned for binding to the target (e.g., IL-6). However, some of the monomers may bind at locations on the target that are far away from each other, such that the domains that bind to these sites cannot be connected by a linker peptide. It is therefore useful to create and screen a large library of homo- or heterotrimers from these monomers before optimization of the monomers. These trimer libraries can be screened, e.g., on phage (typical for heterotrimers created from a large pool of monomers) or made and assayed separately (e.g., for homotrimers). By this method, the best trimer is identified. The assays may include binding assays to a target or agonist or antagonist potency determination of the multimer in functional protein- or cell-based assays.

The monomeric domain(s) of the single best trimer are then optimized as a second step. Homomultimers are easiest to optimize, since only one domain sequence exists, though heteromultimers may also be synthesized. For homomultimers, an increase in binding by the multimer compared to the monomer is an avidity effect.

After optimization of the domain sequence itself (e.g., by recombining or NNK randomization) and phage panning, the improved monomers are used to construct a dimer with a linker library. Linker libraries may be formed, e.g., from linkers with an NNK composition and/or variable sequence length.

After panning of this linker library, the best clones (e.g., determined by potency in the inhibition or other functional assay) are converted into multimers composed of multiple (e.g., two, three, four, five, six, seven, eight, etc.) sequence-optimized domains and length- and sequence-optimized linkers.

Example 6

This example describes a structural analysis of A domains.

As with virtually all proteins, only a small fraction of the total surface of an A-domain participates in binding a single target. Based on the solution structure of the domain, adjacent residue positions can be identified which are likely to be able to cooperate in binding to a given target. Herein, such groups of adjacent residues are referred to as structural categories. As an example, four such categories have been identified through examination of the A-domain structure, designated Top, Bottom, Loop 1, and Loop 2. By designing libraries which only allow diversity within a given category, the theoretical sequence space allowed by a library can be significantly reduced, allowing for better coverage of the theoretical space by the physical library. Further, in the case of non-overlapping categories such as the Top and Bottom categories, half-domain sequences selected against different targets can be combined into a single sequence which would be able to bind simultaneously or alternatively to the selected targets. In either case, creating binding sites that occupy only half a domain allows for the creation of molecules that are half as large and would have half the number of immunogenic epitopes, reducing the risk of immunogenicity.

Structural Classification of A-Domain Positions

A canonical A-domain sequence (SEQ ID NO:487) is shown below with high-diversity positions represented as an X. Positions that belong to either the Top, Bottom, Loop 1, or Loop 2 categories are designated with a star.

|        | 2 | 3 | 4 | 5 | 6 | 7 | 8 | 9 | 10 | 11 | 12 | 13 | 14 | 15 | 16 | 17 | 18 | 19 | 20 |
|        | C | X | X | X | X | F | X | C | X  | X  | X  | X  | C  | I  | X  | X  | X  | W  | X  |
| Top    | ○ | ● | · | · | ● | · | · | ○ | ·  | ·  | ·  | ●  | ○  | ●  | ●  | ·  | ●  | ●  | ·  |
| Bottom | ○ | · | · | · | · | ● | ● | ○ | ●  | ·  | ·  | ·  | ○  | ·  | ·  | ●  | ·  | ·  | ●  |
| Loop 1 | ○ | ● | ● | ● | ● | · | · | ○ | ·  | ·  | ·  | ·  | ○  | ·  | ●  | ●  | ●  | ·  | ·  |
| Loop 2 | ○ | · | · | · | · | · | · | ○ | ●  | ●  | ●  | ●  | ○  | ·  | ·  | ·  | ·  | ·  | ·  |

|  | 21<br>C | 22<br>D | 23<br>G | 24<br>X | 25<br>X | 26<br>D | 27<br>C | 28<br>X | 29<br>D | 30<br>X | 31<br>S | 32<br>D | 33<br>E | 34<br>X | 35<br>X | 36<br>C |
|---|---|---|---|---|---|---|---|---|---|---|---|---|---|---|---|---|
| Top | ○ | ⊙ | ⊙ | ⊙ | ⊙ | ⊙ | ○ | ⊙ | • | ⊙ | • | • | • | • | • | ○ |
| Bottom | ○ | • | • | • | • | • | ○ | • | ⊙ | • | ⊙ | • | • | ⊙ | ⊙ | ○ |
| Loop 1 | ○ | • | • | • | • | • | ○ | • | • | • | • | • | • | • | • | ○ |
| Loop 2 | ○ | • | • | • | • | • | ○ | ⊙ | ⊙ | ⊙ | • | • | • | • | • | ○ |

Example 7

This example describes screening for monomers or multimers that bind human IL-6.

Phage libraries were panned through several rounds either on solid support (e.g. Nunc Maxisorp plates) or in solution (e.g. Dynal Streptavidin). Output phage pools with (a) the highest frequency of individual phage clones that bind to IL-6 and (b) high sequence diversity among the binding-positive phage clones were chosen for protein screening.

I. Round 1

Maxisorp Plates or Dynal Beads

1. Coating Target

A. Coating plates: Six wells/library were directly coated with IL-6 (0.5 µg/well) using 100 µL/well of 5 µg/mL human Il-6 (R & D Systems; carrier free) diluted in TBS[pH 7.5]/2 mM CaCl$_2$. When using a biotinylated form of human IL-6, plates were pre-coated with streptavidin for 1 hr at room temperature with shaking. In addition, one negative control well/library was coated with TBS[pH 7.5]/2 mM CaCl$_2$ only. After pre-coating was complete, IL-6 (+biotin) was added and the plates were incubated for 1.5 hr at room temperature with shaking.

B. Coating beads: 20 µL Dynal streptavidin (M-280; Dynal ASA) were incubated with 5 µg biotinylated IL-6, in 500 µL TBS[pH 7.5]/2 mM CaCl$_2$ and rotated at room temperature for 1 hr in Eppendorf tubes. As a negative control, 20 µL Dynal streptavidin without target were incubated in 500 µL of TBS[pH 7.5]/2 mM CaCl$_2$ and rotated at room temperature for 1 hr. Note that Dynal beads were washed at least twice with TBS [pH 7.5]/2 mM CaCl$_2$ before adding target, and beads were coated in bulk.

2. Blocking

A. Blocking Plates: Coating solution was removed and wells were washed one time with 200 µL/well of TBS[pH 7.5]/2 mM CaCl$_2$. 250 µl/well of 1% BSA (protease-free) in TBS[pH 7.5]/2 mM CaCl$_2$ was added and incubated for 1 hr. at room temperature with shaking. Alternative reagents (e.g. casein or milk) can be used for blocking.

B. Blocking Beads: Coating solution was removed and beads were washed twice with TBS [pH 7.5]/2 mM CaCl$_2$ 500 µl 1% BSA (protease-free) was added in TBS[pH 7.5]/2 mM CaCl$_2$ and rotated for 1 hr at room temperature. As noted above, alternative blocking reagents can be used.

3. Washes

A. Wash Plates: Wells were washed three times with 200 µL/well of TBS[pH 7.5]/2 mM CaCl$_2$ to remove excess target.

B. Wash Beads: Beads were washed three times with 1000 µL of TBS[pH 7.5]/2 mM CaCl$_2$ to remove excess target. Beads were allowed to collect on a magnet for a few min after each wash to avoid bead loss.

4. Phage Addition

A. Phage addition to Plates: About 1000 library equivalents (A1 domain naïve phage library) were added in phage addition buffer (1% nonfat dry milk/0.2% BSA (protease-free), or other appropriate blocking agent, in TBS [pH 7.5]/2 mM CaCl$_2$) and incubated at room temperature for 2 hr with shaking. In rounds 2-3, 100 µL total of harvested phage was added to 7 wells (6 target+1 negative control) diluted in phage addition buffer.

B. Phase addition to Beads: About 1000 library equivalents (A1 domain naïve phage library) were added in 500 µl 1% non-fat dry milk+100 µl 1% BSA (protease-free) in TBS [pH 7.5]/2 mM CaCl$_2$ and incubated with rotation at room temperature for 2 hr. In rounds 2-3, 100 µL total of harvested phage were added to beads.

5. Washes

A. Washing Plates: The plates were washed eight to twelve times with 200 µl/well of TBS [pH 7.5]/2 mM CaCl$_2$/0.1% Tween-20 over a period of 10 min.

B. Washing Beads: The beads were washed 8-12 times with 800 µl of TBS [pH 7.5]/2 mM CaCl$_2$/0.1% Tween-20 over a period of 30-45 min. Bead resuspension was facilitated by dispensing wash buffer directly onto collected beads or by pipetting up and down (not by vortexing). Alternatively, a KingFisher apparatus (Thermo LabSystems) or equivalent can be used for bead washing.

Conditions for Stringent Washes (Options)

a. 800 µl of TBS [pH 7.5]/2 mM CaCl$_2$/0.1% Tween-20 at 37° C.;

b. 800 µl of TBS [450 mM NaCl, pH 7.5]/2 mM CaCl$_2$/0.1% Tween-20 at room temperature;

c. Beads were washed normally 6-8 times, then 1 µg of unlabeled IL-6 was added for 1 hr at room temperature or 37° C. Phage that remained bound after this wash were retained for elution/infection;

d. 1% milk/0.2% BSA/with or without 1 M urea/37° C. (high stringency).

6. Competition (Optional):

A. Competition on Plates: Phage were incubated with 100 µL/well of 20 µg/mL (2 µg/well) of sIL-6R plus 7.5 ug gp130 in TBS [pH 7.5]/2 mM CaCl$_2$ for 1 hr at room temperature with shaking. sIL-6R/gp130 eluates were retained for infection of BlueKan K91 E. coli.

B. Competition on Beads: Phage were incubated with 20 µg of sIL-6R and 75 ug of gp130 in 500 µL TBS [pH 7.5]/2 mM CaCl$_2$ for 1 hr at room temperature with shaking. sIL-6R/gp130 eluates were retained for infection of BlueKan K91 E. coli.

7. Phage Elution

A. Elution off of Plates: 100 µL/well of 10 mg/mL trypsin in TBS [pH 7.5]/2 mM CaCl$_2$ was added, and the plates were incubated at 37° C. for 30 min with shaking.

B. Elution off of Beads: 100 µL 10 mg/mil trypsin TBS [pH 7.5]/2 mM CaCl$_2$ was added to beads, which were then incubated at 37° C. (in an Eppendorf rack) for 30 min with shaking.

C. Alternative elution/infection: 200 µL of log-phase BlueKan K$_{91}$ E. coli cells at OD$_{600}$~0.5 were added to each well (for plates) or to aspirated beads. The infection was allowed to proceed for 30 min at 37° C. without shaking. Next, the 200 µL volumes were pooled and added to ~3 mL of 2×YT/0.2 µg/mL tetracycline and shaken for 15 min at 37° C.

8. Infection: (Same for Plate and Bead Protocol)

An appropriate volume of log-phase BlueKan K91 *E. coli* (in 2×YT/40 μg/mL kanamycin) was grown to $OD_{600}$~0.5-0.6. When the culture reached $OD_{600}$, it was placed on ice prior to use, although the time on ice was generally minimized.

A. In a 50 mL sterile conical tube, eluted phage were mixed with 5 mL log-phase BlueKan K91 *E. coli* culture and incubated at 37° C. for 25 min without shaking. The sterile conical tubes were covered with AirPore tape (Qiagen) to facilitate aeration.

B. Tetracycline was added to a final concentration of 0.2 μg/mL and shaken for 15 min at 37° C.

C. A 10 μL aliquot was sampled for titering and serially diluted 10-fold ($10^{-1}$ to $10^{-6}$) in 2×YT, plated in 8 L/dilution spots on 2×YT/20 μg/ml tetracycline plates and incubated overnight at 30° C. or 37° C. The remaining volume of the $10^{-2}$-$10^{-4}$ dilutions was plated to obtain single colonies for subsequent phage ELISAs.

D. Infected 5 mL cultures were diluted ~10-fold into 50 mL 2×YT/20 μg/mL tetracycline and incubated with shaking at 30° C. overnight to saturation.

9. Titering Input Phage Was Used in the Current Round of Panning (Same for Plate and Bead Protocol)

A. 100-fold serial dilutions ($10^{-4}$ to $10^{-10}$) of harvested phage were made in 2×YT.

B. 100 μL/well of a log-phase BlueKan K91 *E. coli* culture at $OD_{600}$ 0.5-0.6 was added to 6 wells of a 96-well polypropylene plate.

C. 10 μL of diluted phage was added to the wells containing 100 μL of BlueKan K91 *E. coli*.

D. Phage/cell mixtures were incubated at 37° C. for 25 min without shaking, and the plates were covered with AirPore tape (Qiagen) to allow for aeration.

E. Tetracycline was added to a final concentration of 0.2 μg/mL and the plate was shaken for 15 min at 37° C.

F. 8 μL of each dilution (104 to $10^{-10}$) was plated onto a dry 2×YT agar/20 μg/mL tetracycline plate.

G. Plates were incubated at 30° C. or 37° C. overnight.

10. Harvesting Phage (Same for Plate and Bead Protocols)

A. Overnight cultures were centrifuged at 7000 rpm in disposable 50 mL tubes for 25 min to pellet cells.

B. A standard PEG/NaCl phage-precipitation procedure was performed by adding ⅕ volume of a 20% PEG/15% NaCl stock to culture supernatant. It was mixed well by repeatedly inverting and incubating on ice for 45 min to 1 hr.

C. The culture was centrifuged at 7000 rpm for 40 min to pellet phage and the supernatant was discarded.

D. The phage pellet was resuspended in 1 mL TBS [pH 7.5]/2 mM $CaCl_2$, transferred to an Eppendorf tube and centrifuged at 13K rpm for at least 2 min to pellet insoluble material.

E. Supernatant was transferred to a fresh tube and ⅕ volume of PEG/NaCl was added, mixed and incubated on ice for ~5 min.

F. The mixture was then centrifuged at 13000 rpm for at least 2 min, and the supernatant was removed. The pelleted, purified phage were resuspended in up to 1 mL TBS [pH 7.5]/2 mM $CaCl_2$ and stored at 4° C.

II. Round 2 and Round 3 Panning

The $2^{nd}$ and $3^{rd}$ round panning conditions were generally the same as in Round 1 described above, except the coated target (i.e. IL-6) amount was decreased 2- to 4-fold for each subsequent round, and the plates (or beads) were washed 2-4 additional times in each subsequent round of panning.

III. Optional Intra-Domain Recombination

Monomer sequences in phage display-selected phage pools were recombined in the following procedure. This process generated hybrid monomers derived from mixed halves of the starting monomer collection in a given pool(s). For A1-domain-based phage libraries, the primer pairs SHF1 (ATTATGCCCCGGGTCTGGAGGCGTC; SEQ ID NO:488)/SHBoverlap (CGCCGTCGCAA; SEQ ID NO:489) and SHFoverlap (TTGCGACGGCG; SEQ ID NO:490)/B3 (TCGGCCCCAGAGGCCTGCAATG; SEQ ID NO:491) were used to PCR-amplify the two halves of the monomers. The 2 halves were fused together with LA Taq polymerase (Takara). Next, the fused hybrid coding sequences were amplified by primers SHF2 (CCGGATTAT-GCCCCGGGTCTGGA; SEQ ID NO:492) and SHB4 (AA-CAGTTTCGGCCCCAGAGGCCTGC; SEQ ID NO:493). Purified PCR products were digested by SfiI (NEB) and ligated with the SfiI-digested fUSE5HA phage vector to generate recombined monomer libraries. Recombined libraries were panned at least two more rounds against IL-6 and screened as described below. Data from characterization of recombined monomers is in Tables 1 and 2.

IV. Analysis of Panning Output

Same for Plate and Bead Protocols

Phage ELISAs: For each output "phage pool" to be analyzed (typically Rounds 2, 3 and 4, if applicable), independent clones were inoculated into 1 mL (2×YT/20 μg/mL tetracycline) cultures grown in Costar 96-well polypropylene deep-well plates. Inoculating tips were left in, and plates were shaken overnight at 37° C. Cells were pelleted by centrifugation at 3600 rpm for 15 min. Culture supernatants were retained and ELISAs were performed as described below.

Non-biotinylated IL-6 (0.1 μg/well) was directly coated onto Nunc Maxisorp plates. However, biotinylated IL-6,96-well Nunc Maxisorp plates should first be coated with 50 μL/well of 50 μg/mL (2.5 μg/well) of streptavidin, diluted in TBS [pH 7.5]/2 mM $CaCl_2$. The plate was incubated at 37° C. for 1 hr with shaking. Plates were washed three times with 200 μL/well of TBS [pH 7.5]/2 mM $CaCl_2$. Wells were blocked with 200 μL/well of 1% BSA (fraction V) and the covered plate was incubated at RT for 1 hr with shaking. The plate was washed three times with TBS [pH 7.5]/2 mM $CaCl_2$. Next, the 96-well Maxisorp plate was coated with 100 μL/well of 1 μg/mL (0.1 μg/well) biotinylated IL-6 diluted in TBS [pH 7.5]/2 mM $CaCl_2$ or 100 μL/well buffer only (negative control). The plate was incubated at RT for 1 hr with shaking. Plates were washed three times with TBS [pH 7.5]/2 mM $CaCl_2$. Next, 30 μL of each phage supernatant is added to wells in the presence of 70 μL of 1% Milk/0.2% BSA/[pH 7.5]/2 mM $CaCl_2$/0.02% Tween-20. Covered plates were incubated at RT for 1.5 hr with shaking.

Plates were washed four times with TBS [pH 7.5]/2 mM $CaCl_2$/0.02% Tween-20. Next, 100 μL/well of α-M13-HRP monoclonal antibody (Amersham Pharmacia), diluted 1:5000 in TBS [pH 7.5]/2 mM $CaCl_2$+0.02% Tween-20, was added. Plates were incubated at 4° C. for 1 hr with shaking. Plates were washed three times with cold TBS [pH 7.5]/2 mM $CaCl_2$/0.02% Tween-20. 100 μL/well of TMB/$H_2O_2$ mixture (Pierce), diluted 1:1, was added for ELISA development.

The reactions were allowed to turn blue until the strongest $OD_{650}$ signals reached ~1.0. The reaction was stopped with 100 μL/well $2NH_2SO_4$, and positive wells changed in color from blue to yellow. Once the reaction was stopped, it was read at $OD_{450}$ on an ELISA plate reader using SoftMaxPro software.

Phage ELISA-positive phage pools were chosen for subcloning into an expression vector if they had (a) a high frequency of individual phage clones that bound to hIL-6 and (b) high sequence diversity among the binding-positive phage clones. Pools meeting these criteria were chosen for protein screening in the process outlined below. To subclone the monomer or multimer sequences from a given phage pool into the expression vector, pEve, approximately $10^8$-$10^{10}$ phage were amplified by 25 cycles of PCR as follows:

```
PCR recipe
0.5-1 µL purified phage

5 µL 10X Buffer

8 µL 2.5 mM dNTPs

5 µL 10 uM VS-For primer
(5'-ATCATCTGGCCGGTCCGGCCTACCCGTATGATGTTCCGGA-3';
SEQ ID NO: 494)

5 µL 10 uM EveNut primer
(5'-AAAAGGCCCCAGAGGCCTTCTGCAATGAC-3';
SEQ ID NO:495)

26 µL H₂O 0.5 µL LA Taq polymerase (1 unit) (Takara)

Cycles: 25 X [94° C./10 sec., -45° C./30 sec.,
-72° C./30 sec.]
```

PCR products were run on a 3% agarose gel for analysis. The monomer or multimer product (approximately 200 bp) was purified with a QIAquick spin column (Qiagen), digested with Sfi I (NEB), purified again with a QIAquick column and then ligated using T4 DNA Ligase (NEB) to the Sfi I digested vector, pEve. The ligation was transformed into electrocompetent BL21 (DE3) *E. coli* and plated onto 2×YT plates containing kanamycin at 40 µg/mL. Following overnight growth, approximately 6000 individual clones were inoculated into 2×YT/kanamycin and grown overnight. Positive and negative controls were also included on the plates.

V. Screening of Thousands of Monomer Proteins in 1 mL Cell Lysates

Protein Production of 1 mL heated lysates (Day 1): Individual clones were inoculated into wells of a 96-well Costar deep-well plate containing 500 µL/well of 2×YT/40 µg/mL kanamycin. Cultures were grown overnight (inoculating tips were left in wells) while shaken at 300 rpm at 37° C. This process allowed screening of thousands of individual, partially-purified monomers at the cell-lysate level.

(Day 2) 100 µL of overnight culture was inoculated into new 96-well Costar deep-well plate containing 1 mL/well of 2×YT/40 µg/mL kanamycin+1 mM $CaCl_2$. (The remaining overnight culture was archived by the addition of 25% final glycerol concentration and then stored at −80° C. for later use.) Plates were covered with AirPore Tape (Qiagen) and cultures were grown with shaking at 375 rpm at 37° C. until an $OD_{600}$ of ~0.8 to 1.0 was reached. Once the desired $OD_{600}$ was reached, cultures were induced with 1 mM IPTG for 3 hr while shaking at 375 rpm at 37° C. Plates containing induced cultures were then centrifuged for 15 min at 3600 rpm at 4° C. to pellet cells. Supernatant was removed and discarded, and the remaining cell pellet was resuspended in 100 µL of TBS [pH 7.5]/1 mM $CaCl_2$. Resuspended cells were transferred from the 96-well deep-well plate to a 96-well polypropylene PCR plate and heated for 5 min at 65° C. in a PCR machine. Heated/lysed cells were then centrifuged for 15 min at 3600 rpm at 4° C. After centrifugation, protein production was complete, and protein lysates were ready for characterization in a primary screen via binding ELISA and/or competition AlphaScreen assays.

IL-6 Protein ELISA: 96-well Maxisorp plates were coated with 100 µL/well of 1 µg/mL (0.1 µg/well) IL-6 (R&D systems) diluted in TBS[pH 7.5]/1 mM $CaCl_2$, and the plate was incubated at 4° C. overnight or room temperature (RT) for 1.5 hr with shaking. Wells were emptied and then blocked with 200 µL/well of 1% BSA (fraction V)/TBS[pH7.5]/1 mM $CaCl_2$. The covered plate was incubated at RT for 1 hr with shaking. The plate was washed three times with TBS [pH 7.5]/1 mM $CaCl_2$. Protein from 1 mL lysate preparations was added to the wells as a single point concentration diluted 1:10 in TBS [pH 7.5]/1 mM $CaCl_2$/0.1% BSA/0.02% Tween-20 to a final volume of 100 µL per well. Covered plates were incubated at RT for 1.5 hr with shaking. The plate was washed three times with TBS [pH 7.5]/1 mM $CaCl_2$/0.02% Tween-20. 100 µL/well of anti-HA-HRP detection antibody (Roche) diluted 1:2000 in TBS [pH 7.5]/1 mM $CaCl_2$/0.1% BSA/0.02% Tween-20 was added. Covered plates were incubated at RT for 1 hr with shaking. The plate was washed three times with TBS [pH 7.5]/1 mM $CaCl_2$/0.02% Tween-20. 100 µL/well of TMB/$H_2SO_4$ mixture diluted 1:1 was added. Color was allowed to turn blue until $OD_{650}$ of the strongest signals reached ~1.0. The reaction was stopped with 100 µL/well of $2NH_2SO_4$. Once stopped, the plate was read on ELISA plate reader at $OD_{450}$.

AlphaScreen IL-6/Fc-biotinylated (bn) IL-6 homogeneous competition assay: All assay components were diluted in AlphaScreen Buffer: 40 mM HEPES [pH 7.4] w/NaOH, 1 mM $CaCl_2$, 0.1% BSA (w/v), 0.05% Tween-20, 100 mM NaCl. Three additions were made to a white, 384-well, reduced-volume, Greiner microtiter assay plate with no incubation time in between additions. First, monomers or unlabeled recombinant human IL-6 (rhIL-6, R&D Systems)(as positive control) were added to the plate at 4 µL/well. Monomers from 1 mL heated lysate preparations were added to the wells at a single concentration (either undiluted [i.e. 1:4 final assay dilution] or up to a 1:100 dilution [1:400 final assay dilution]). As a positive control, instead of monomer protein, 4 µL/well of unlabeled rhIL-6 was added to the plate as a twelve-point concentration curve starting with 400 nM (i.e. 100 nM final assay concentration) and then 1:4 serial dilutions thereafter with the last point as buffer only. Secondly, 2 µL/well of bn-rhIL-6 at 1 nM (i.e. 0.25 nM final assay concentration) was added to the plate. Note that the remainder of the assay was done in subdued or green-filtered light as AlphaScreen beads are light sensitive. Thirdly, 2 µL/well of a mixture of IL-6R at 28 nM (7 nM final concentration) and gp130/Fc at 1.6 nM (0.4 nM final concentration) and AlphaScreen Streptavidin "donor beads" and Protein A "acceptor beads" (PerkinElmer) both diluted to 40 µg/mL (i.e., 10 µg/mL final assay concentration) was added to the plate. The assay plate was then covered with topseal and spun down for ~30 sec at 800 rpm. The plate was then incubated overnight in the dark at room temperature and read the next day on the Fusion Plate reader (PerkinElmer).

VI. Multimerization and Recombination of Phage Display-Selected Monomers

Monomers that have been subcloned into pEve (pEve/monomer) were multimerized in the following manner. pEve/monomer plasmids (individually or in pools) were digested with either BsrDI or BpmI (NEB). The ~1.1 kb BsrDI and ~2.9 BpmI fragments were isolated from 1% agarose gels and purified with Qiagen QIAquick spin columns. Pools of each of the two fragments were ligated using T4 DNA ligase (NEB); subsequently, the ligation was purified with a Qiagen QIAquick spin column. Using the primers VS-For and EveNut described in the phage subcloning section above, the multimer coding sequences were PCR-amplified from the ligation. The PCR products were purified and digested with SfiI (NEB), followed by ligation with pEve and transformation of BL21 (DE3) *E. coli*. This method created dimers comprised of different combinations of the starting monomers. This method can also be used to generate other multimers, such as trimers. When making trimers, pools of pEve/ dimers (e.g. in above example) and pEve/monomers (the starting collection) are the starting materials. They are processed as above. A molecular biology procedure similar to that described below for making "walking libraries" was also used to generate multimers. In all cases, proteins were expressed, purified and screened as above.

Additional libraries, referred to as "walking libraries," were generated by ligating phage display-selected monomers (i.e. selected monomers) with the full representation of a naïve monomer library. These libraries were constructed in the following manner. PCR was used to amplify in two separate reactions: a) the coding sequences of the selected monomers with pETF (ACCCGTATGATGTTCCGGATTA; SEQ ID NO:496)/pETB2r (GATGTATTCGGCCCCAGA GGC-CTGCAATGAC; SEQ ID NO:497); and b) the coding sequences of naïve monomers in a monomer library with 21new1 (GAAATTCACCTCGAAAGCAA; SEQ ID NO:498)/23 (ATGGGTTCCTATTGGGCT; SEQ ID NO:499). The ~200 bp products were isolated from a 3% agarose gel and purified with Qiagen QIAquick spin columns. Each product from (a) and (b) above was digested with either BsrDI or BpmI (NEB) in separate reactions. BpmI-digested monomers have an overhang which can be ligated to BsrDI-digested monomers. The purified digestion products were ligated to one another using T4 DNA ligase (NEB). Ligation of BsrDI-cut naïve monomers with BpmI-cut selected monomers generates a walking dimer library comprised of N-terminal naïve monomers fused to C-terminal selected monomers. Ligation of BpmI-cut naïve monomers with BsrDI-cut selected monomers generates a walking dimer library comprised of C-terminal naïve monomers fused to N-terminal selected monomers. Primers pETF/pETB2r were used to PCR-amplify the ligated dimer coding sequences from the ligation, and the purified products were digested with SfiI followed by XmaI. The digested products were ligated to the phage vector fUSE5HA for the generation of a phage display dimer "walking library", typically with 108-109 unique members. A trimer (or larger multimer) "walking library" can be generated in a similar fashion, except that the starting materials are dimers (or larger) and naïve monomers. Walking libraries were panned against IL-6 and screened as described above.

VII. Characterization of Purified Monomers in Binding and Competition Assays

Once proteins were characterized at the heated protein lysate level, the best monomers were chosen for further characterization. Larger-scale cultures of individual clones were prepared and the monomers, which bear a 6×His (SEQ ID NO:379) tag, were purified via Ni-NTA resin. These nickel-purified monomers were assayed in binding ELISAs and the AlphaScreen competition assay. Protein sequence data and biochemical data from characterization of purified monomers are in Tables 1 and 2.

Protein Purification 500 mL Cultures for NiNTA: (Day 1) In a 15 mL culture tube containing 3 mL of 2×YT+40 μg/mL kanamycin, the appropriate "primary hit well" archived glycerol stock was inoculated. Culture was shaken overnight at 300 rpm at 37° C.

(Day 2) 2 mL of overnight culture was inoculated into 1 L Erlenmeyer shake flask containing 500 mL of 2×YT+40 μg/mL kanamycin. Cultures were grown with shaking at 375 rpm at 37° C. until an $OD_{600}$ of about 0.8-1.0 was reached. Once desired $OD_{600}$ was reached, cultures were induced with 1 mM final concentration of IPTG for 3 hr while shaking at 375 rpm. After 3 hr induction, the 500 mL culture was transferred to clean/autoclaved Sorvall tube and centrifuged for 8 min at 8000 rpm at 4° C. to pellet cells.

Once cells were pelleted, supernatant was removed and discarded, and 20 mL of sonication buffer (10% sucrose/20 mM Tris [pH 7.5]/150 mM NaCl/0.2 mM $CaCl_2$) was added to each tube. The pellet was resuspended in sonication buffer with 10 mL serological pipet until there were no visible clumps, and then the resuspended cells (~30 mL) were transferred into 35 mL Oakridge Tubes and sonicated for 8 min at ~16 power output. After sonication, the warm Oakridge Tubes containing sonicated cells were placed in a ice/water bath for ~10 min to cool. Once cooled, tubes were centrifuged for 30 min at 18,000 rpm at 4° C. to pellet lysed cells.

While tubes containing lysed cells were being centrifuged, NiNTA resin (Qiagen) was washed with Milli-Q water to remove ethanol. 3 mL of 1:1 diluted NiNTA resin/protein was used (i.e. actually 1.5 mL of resin/protein was used). 3 mL of resin/water mix each was added to appropriately labeled (with protein ID) clean 50 mL screw cap tube. After sonicated cells were pelleted, protein supernatant was removed and added to 50 mL tube containing the 1.5 mL of washed NiNTA resin. Protein was allowed bind to NiNTA resin by rocking gently for 0.5 hr. @ RT. After incubation with NiNTA resin, 50 mL tubes with NiNTA bound to protein was centrifuged for 10 min at ~1500 rpm. Supernatant was gently poured out and discarded.

NiNTA resin+bound protein was transferred to appropriately labeled 15 mL Clontech columns by adding 1 mL of NiNTA Wash Buffer (20 mM Tris [pH 7.5], 200 mM NaCl, 0.1 mM $CaCl_2$, 20 mM imidazole) to 50 mL tube containing resin, swirling to resuspend, then pipetting the mixture into a column which has been mounted on a vacuum manifold. NiNTA resin+bound protein was washed with at least 10 column volumes (15 mL) of NiNTA wash buffer. 15 mL columns containing NiNTA resin+bound and washed protein were transferred to a clean 15 mL screw cap collection tubes and 4 mL of Ni Elution buffer (20 mM Tris [pH 7.5], 200 mM NaCl, 0.1 mM $CaCl_2$, 200 mM imidazole) was added to each column to elute off protein into the 15 mL collection tube. It was then allowed to elute by gravity.

Eluted protein was transferred to slide-A-lyzer cassette (appropriate MW cutoff—for monomers used 3.5 kDa cutoff and for dimers and trimers used 10 kDa cutoff) using 18.5 gauge needle and 5 mL syringe to load cassette. Slide-A-lyzers containing eluted proteins were placed into overnight dialysis buffer containing redox reagents (20 mM Tris [pH 7.5], 100 mM NaCl, 1 mM $CaCl_2$, 1 mM 2-mercaptoethanol, 0.25 mM 2-hydroxyethyldisulfide).

(Day 3) Slide-A-lyzer cassettes containing overnight dialyzed proteins were transferred into dialysis buffer without redox (20 mM Tris [pH 7.5], 100 mM NaCl, 1 mM $CaCl_2$). After 3 hr dialysis, slide-A-lyzer cassettes were transferred into fresh TBS/$CaCl_2$ without redox for another 3 hr. After $2^{nd}$ dialysis change, proteins were removed from slide-A-lyzer cassettes using 18.5 gauge needle and 5 mL syringe, and protein was transferred by filtering using 0.2 micron syringe filter into appropriately labeled 15 mL polypropylene tube.

The anti-IL-6 NiNTA purified proteins, which were selected as the "best inhibitors" in AlphaScreen competition assays or "best binders" in a binding ELISA, were further purified by Q-Sepharose anion exchange to remove contaminants. Q-Sepharose Purification: 1 mL of Q-Sepharose Fast-Flow Resin (Amersham Biosciences) was added to 15 mL Clontech column. Resin with 15 column volumes (or 15 mL) of 20 mM Tris [pH 7.5], 50 mM NaCl, 1 mM $CaCl_2$ was equilibrated. 2 mL (~5 mg) of filtered NiNTA-purified protein was added to resin and protein was allowed to bind to resin by gravity. Flow-through into first column of 96-well plate was collected. Columns loaded with protein were transferred to 15 mL collection tube and resin/bound protein were washed with 10 column volumes (or 10 mL) of 20 mM Tris [pH 7.5], 50 mM NaCl, 1 mM $CaCl_2$. Once washed, NaCl gradient elution of protein was started. NaCl concentration was varied in gradient as follows: 100 mM, 150 mM, 200 mM, 250 mM, 300 mM, 350 mM, 400 mM, 500 mM, and finally 1 M NaCl, to a base of 20 mM Tris [pH 7.5], 1 mM CaCl$_2$. Fractions were collected in 96-well deep-well polypropylene plate—2 mL/fraction, in 1 mL increments. Fractions containing protein were tested by Bradford and analyzed by SDS PAGE. Fractions were tested in binding ELISAs and competition assays as described above with the following change. Protein from 500 mL NiNTA purified preparations or NiNTA+Q-sepharose purified preparations was added to the plate as a twelve-point concentration curve starting with a 1:5 to 1:100 first dilution and then 1:4 serial dilutions thereafter with the last point as buffer only.

IL-6 Binding Monomers & Dimers

The following provides a summary of the IL-6 binding monomers identified, grouped by sequence homology. There are 7 families, wherein members of the same family have related sequences.

The information can be summarized as follows. Sequences in brackets ("[ ]") indicate alternative amino acids at a single position. The consensus sequences below include question marks ("?"). These indicate positions that can be present or absent.

```
Family 1 motif (SEQ ID NO: 27):
CX [AS] [DN] EFXCXXGXC [ILV] XXAXXCDGV [DN] DCXDNSDEXXC [AST] XX [AST]

Family 2 motif (SEQ ID NO: 28):
CXXXQFXC [DN] NGXCVPXXWXCDG [DE] [DN] DCXD [DN] SDEXXCXXP [AST]

Family 3 motif (SEQ ID NO: 29):
CXXXQFQCXSG [W, Y] C [I, L, F] XXXW [V, L] CDGXNDCEDXSDEXXC Family 4 motif (SEQ ID NO: 30):
CXXX [EQ] FXCXXGXC [ILV] XXXXXCDGX [DN] DCXDXSDEXX (XX) C Family 5 motif (SEQ ID NO: 31):
CX [A, P] X [E, Q] FXCXXGQC [I, L] PXXXXCDGX [D, N] DCXDXSDEXXC Family 6 motif (SEQ ID NO: 32):
CXXX [EQ] FXCX (X) SXXC [ILV] XX [DN] W [ILV] CDGVNDCXDXSDEXGCXXXT Family 7 motif (SEQ ID NO: 33):
CL [AS] X [EQ] FXCXNGXCIP [KQR] XWVCDGDNDC [ILV] DXSDE (P) XXCX [EKQ] XT
```

Details of each IL-6-binding family follows. Spacing (or dashes ("-") is only for alignment purposes. Each line represents one contiguous monomer domain.

| Fam1 (SEQ ID NOS: 500-519) |
|---|
| CPSDEFRCRNGRCIPRAWRCDGVNDCADNSDEEDCTEHT |
| CPSDEFRCRNGRCVPRAWRCDGVNDCADNSDEEDCTEHT |
| CPSDEFRCRNGRCIPRAWRCDGVNDCADNSDEEDCTENT |
| CPSDEFRCRNGRCIPRAWRCDGVNDCADNSDEEDCTQHT |
| CPSDEFRCRNGRCIPRAWRCDGVNDCADNSDEEGCTPHT |
| CPSDEFRCRNGRCIPRAWRCDGVNDCADNSDEADCKAHT |
| CPSDEFRCRNGRCIPRAWRCDGVNDCADNSDEADCAAPT |
| CPSDEFRCRNGRCIPRAWRCDGVNDCGDNSDETNCAPPT |
| CPSDEFRCRNGRCIPRAWRCDGVNDCGDSSDETSCSAPASEPPGSL |
| CPSDEFRCRNGRCIPRAWRCDGVNDCADNSDEANCAGSVPT |
| CPASEFRCNNGRCIPAQWRCDGVNDCGDDSDEASCQAPT |
| CQANEFTCSSGNCLSPALLCDGVDDCGDNSDETNCASPAPT |
| CQANEFTCSSGNCLSPALLCDGVDDCGDNSDETYCASPAPT |
| CQANEFTCSSGNCLSPALLCDGVDDCGDNSDETYCAGPAPT |
| CELNEFTCSSGNCLSPALLCDGVDDCGDNSDETNCASPAPT |
| CGANEFTCDNGRCLSPDLVCDGVDDCADSSDETDCQKPM |

CRPDEFKCENGHCIPPGLRCDGVDDCVDNSDETDCETPGRT

CPSDEFRCNGRCIPPGWLCDGVDDCVDDSDEEGCRTPART

CGSNEFTCSNGRCIPPTLLCDGVNDCGDDSDETGCATPVRT

CASSQFPCDNGKCLPPPLVCDGVDDCGDDSDEPSAPCGSPART

| score | matches | expected | motif (SEQ ID NOS: 520-528) |
|---|---|---|---|
| 3738 | 47 | $10^{-16}$ | c...[eq]f.c..g.c[ilv].....cdgv[dn]dc.d.sde........... |
| 3963 | 46 | $10^{-18}$ | c...ef.c..g.c[ilv].....cdgv[dn]dc.d.sde..c........ |
| 4029 | 45 | $10^{-19}$ | c..[dn]ef.c..g.c[ilv].....cdgv[dn]dc.d.sde..c........ |
| 3995 | 43 | $10^{-20}$ | c..[dn]ef.c..g.c[ilv].....cdgv[dn]dc.d[dn]sde..c......  .. |
| 3922 | 41 | $10^{-21}$ | c.[as][dn]ef.c..g.c[ilv].....cdgv[dn]dc.d[dn]sde..c...  ..... |
| 3919 | 40 | $10^{-22}$ | c.[as][dn]ef.c..g.c[ilv]..[ast]..cdgv[dn]dc.d[dn]sde..c........ |
| 3920 | 39 | $10^{-23}$ | c.[as][dn]ef.c..g.c[ilv]..a..cdgv[dn]dc.dnsde..c......  .. |
| 3907 | 38 | $10^{-23}$ | c.[as][dn]ef.c..g.c[ilv]..a..cdgv[dn]dc.dnsde..c[ast].  ...... |
| 3890 | 37 | $10^{-24}$ | c.[as][dn]ef.c..g.c[ilv]..a..cdgv[dn]dc.dnsde..c[ast].  .  [ast]... |

| Fam2 (SEQ ID NOS: 529-532) |
|---|
| CLSSQFQCDNGNCVPQQWVCDGDNDCLDDSDETSCSAPASEPPGSL |
| CLADQFQCNNGRCVPQSWGCDGDDDCQDNSDETSCAPPT |
| CAPGEFTCGSGRCVPQTWRCDGVDDCLDSSDETDCSAPASEPPGSL |
| CPPGQFTCNNGRCVPPTWLCDGEDDCQDDSDEKNCKAPT |

| score | matches | expected | motif (SEQ ID NOS: 533-534) |
|---|---|---|---|
| 402 | 4 | $10^{-23}$ | c...[eq]f.c..g.cvp..w.cdg.[dn]dc.d.sde..c..p[ast] |
| 349 | 3 | $10^{-28}$ | c...qf.c[dn]ng.cvp..w.cdg[de][dn]dc.d[dn]sde..c..p[ast] |

| Fam3 (SEQ ID NOS: 535-554) |
|---|
| CRASQFQCGSGYCIPRPWLCDGDNDCEDDSDETNCTPRT |
| CLPSQFQCRNGRCIPLPWLCDGDNDCEDDSDETNCTPRT |
| CEADQFQCGSGYCLPRHWVCDGDNDCEDDSDETDCGRPGPGATSAPAV |
| CLPSQFQCGSGYCISQRWVCDGEHDCEDSSDEANCAGSVPT |
| CLPSQFQCGSGYCISQRWVCDGENDCEDSSDEANCAGSVPT |
| CPSSQFQCSSGWCISQRWVCDGENDCEDSSDEANCAGSVPT |
| CPSSQFQCSSGWCISQRWVCDGENDCEDGSDEANCAGSVPT |
| .......CSSGWCISQRWVCDGENDCEDSSDEANCAGSVPT |
| CPSSQFQCGSGWCISQHWVCDGENDCEDGSDEANCAGSVPT |
| CLPSQFQCGSGWCISQRWVCDGENDCEDSSDEANCAGSVPT |
| CLPSQFRCGSGCCFSQRWVCDGKNDCEDSSDEANCAGSLPT |
| CGASQFQCGSGYCISQRWVCDGENDCEDSSDEANCAGSVPT |
| CLPSQFQCGSGYCISQRWVCDGENDCEDGSDEANCAGSVPT |

```
             CAPSQFQCGSGYCISQRWVCDGENDCEDGSDEANCAGSVPT

CLPDQFQCGSGYCISQRWVCDGENDCEDSSDEANCAGSVPT

CLPGQFQCGSGYCISQRWVCDGENDCEDGSDEANCAGSVPT

CLPDQFQCGSGYCISQRWVCDGENDCEDGSDEANCAGSVPT

CLPDQFQCGSGYCLSQRWVCDGENDCEDGSDEANCAGSVPT

CLPDQFQCGSGYCLPQRWVCDGENDCEDSSDEANCAGSVPT

CLPDQFQCGSGYCLPQRWVCDGENDCEDGSDEANCAGSVPT
```

| score | matches | expected | motif (SEQ ID NOS: 555-562) |
|---|---|---|---|
| 6106 | 61 | $10^{-23}$ | c...qf[kqr]c..g.c[filmv]...w[ilv]cdg..dced.sde[ast][dn]c...... |
| 6399 | 60 | $10^{-25}$ | c...qf[kqr]c.sg.c[filmv].[kqr].w[ilv]cdg..dced.sde[ast][dn]c...... |
| 6821 | 59 | $10^{-27}$ | c...qfqc.sg[fwy]c[ilv].[kqr].w[ilv]cdg[de].dced.sde[ast][dn]c...... |
| 6968 | 58 | $10^{-29}$ | c...qfqc.sg[fwy]c[ilv].[kqr].w[ilv]cdg[de]ndced.sde[ast][dn]c...... |
| 7842 | 57 | $10^{-34}$ | c...qf[kqr]c.sg.c[filmv].q.wvcdg[ekq].dced.sdeancags[ilv]pt |
| 8205 | 56 | $10^{-37}$ | c...qfqc.sg[fwy]c[ilv].q.wvcdge.dced.sdeancagsvpt |
| 8307 | 55 | $10^{-38}$ | c...qfqc.sg[fwy]c[ilv].q.wvcdgendced.sdeancagsvpt |
| 8387 | 54 | $10^{-39}$ | c...qfqc.sg[fwy]c[ilv].qrwvcdgendced.sdeancagsvpt |

```
                    Fam4 (SEQ ID NOS: 563-576)

CLPDQFQCGSGYCLPQAWVCDGENDCEDGSDETN..CPART

CLPDQFQCGSGYCLPQRWVCDGVDDCEDSSDEKG..CTPHT

CLSDQFQCGSGHCLPASWRCDGEDDCADSSDETS..CTASEPT

CPSSQFQCSSGWCIPEDWRCDGVPDCGDGSDEASDH

CAPSQFQCGSGYCIPLTWVRDGVDDCEDGSDEED..CSQDPEFHKV

CLPNQFTCDSGNCVPQALGCDGNDCEDNSDESPALCAAPAHT

CLPNEFTCDSGNCVPQALGCDGNDCEDNSDESPALCAAPAHT

CAPNQFQCGSGYCVPAAWVCDGENDCEDNSDESSALCQERT

CLPDQFPCENGKCLPVNLVCDGDDDCPDGSDESEV.CAGAVRT

CPSSQFRCNNGHCLSVTLVCDGDNDCEDDSDETG..CEGSGHT

CQPGEFTCESGRCLPLRWLCDGEDDCVDSSDEAS..CQPPT

CLSGEFTCENGNCLSLSLVCDGEDDCEDGSDEAS..CPPPT

CPPDEFQCNSGSCLSQPLLCDGEDDCGDGSDEES..CIAAEHT

CQPGQFRCNNGHCLSQPLVCDGVPDCEDGSDEAS..CSAPASEPPGSL
```

| score | matches | expected | motif (SEQ ID NOS: 577-579) |
|---|---|---|---|
| 994 | 15 | $10^{-12}$ | c...[eq]f.c..g.c[ilv]......dg..dc.d.sde............ |
| 1011 | 14 | $10^{-14}$ | c...[eq]f.c..g.c[ilv].....cdg..dc.d.sde............ |
| 907 | 12 | $10^{-15}$ | c...[eq]f.c..g.c[ilv].....cdg.[dn]dc.d.sde.............. |

Fam5 (SEQ ID NOS: 580-591)

CLPDQFRCGNGQCIPLDWVCDGVNDCADNSDETGCPTRT

CLPDQFRCGNGQCIPLDWVCDGVNDCGDNSDEAGCPTRT

CLPDQFRCGNGQCIPLDWVCDGVNDCADNSDEAGCPPRT

CLPDQFRCGNGQCIPLDWVCDGVNDCVDGSDEAGCPPRT

CLPDQFRCGNGQCIPLDWVCDGVNDCEDSSDEAGCPPRT

CLPDQFRCGNGQCIPLDWVCDGVNDCEDDSDEESCPPRT

CLPDQFRCGNGQCIPLDNVCDGVNDCEDDSDEESCPPHT

CLPDQFRCGNGQCIPLDWVCDGVNDCPDDSDEEGCPPRT

CVPDQFPCGNGQCIPLDWVCDGVDDCEDNSDEKSCPPPR

CLPGQFRCDNGQCIPAHWGCDGVNDCRDNSDEADCPQPT

CQASEFPCDSGQCIPQPLGCDGDNDCADNSDEESCQPRT

CEPGQFPCESGQCLPPPWVCDGVNDCADNSDEEDCGDSHILPFSTPGPST

| score | matches | expected | motif (SEQ ID NOS: 592-597) |
|---|---|---|---|
| 2083 | 23 | $10^{-20}$ | c...[eq]f.c..gqc[ilv]p....cdg.[dn]dc.d.sde..c............... |
| 2345 | 22 | $10^{-25}$ | c.p.qf.c..gqc[ilv]p..w.cdgv[dn]dc.d.sde..c............ |
| 2510 | 21 | $10^{-29}$ | c[ilv]p.qf.c.ngqcip..w.cdgv[dn]dc.d.sde..cp............ |
| 2784 | 20 | $10^{-34}$ | c[ilv]pdqf.cgngqcipldwvcdgv[dn]dc.d.sde..cp............ |
| 2850 | 19 | $10^{-38}$ | clpdqfrcgngqcipldwvcdgvndc.d.sde..cp..t............ |
| 2777 | 18 | $10^{-39}$ | clpdqfrcgngqcipldwvcdgvndc.d.sde..cp.rt............ |

Fam6 (SEQ ID NOS: 598-609)

CLPSEFQCRDSKICLSADWLCDGVNDCADNSDEEGCPPPT

CLPSEFQCRDSKICLSADWLCDGVNDCVDGSDEAGCPPRT

CEANELRCS-SGRCLSVHWLCDGVDDCEDSSDEAGCPPRT

CPASQFPCS-SGHCVPLNWVCDGVNDCVDGSDEAGCPPRT

CESDQFQCD-SGHCVPLNWVCDGVNDCVDGSDEAGCPPRT

CPSDEFTCD-SGRCVSLNWLCDGVNDCGDNSDEAGCPTRT

CLSDEFTCD-SGRCVSLNWLCDGVNDCGDNSDEAGCPTHT

CPSSQFRCS-SGRCVPADWLCDGVNDCADNSDETGCPTRT

CPSSQFRCS-SGRCVPADWLCDGVNDCADNSDETGCATRT

CPSSQFRCS-SGRCVPADWLCDGVNDCGDNSDEAGCPTRT

CRADEFQCG-SGRCVPADWLCDGVNDCADNSDETGCPTRT

CVSSQFQCG-NGHCVPAQWLCDGVNDCGDNSDEASCPPRT

| score | matches | expected | motif (SEQ ID NOS: 610-615) |
|---|---|---|---|
| 2122 | 23 | $10^{-20}$ | c...[eq][fly].c..?...c[ilv]...w[ilv]cdgv[dn]dc.d.sde..c...t |
| 2199 | 22 | $10^{-23}$ | c...[eq][fly].c..?s..c[ilv]...w[ilv]cdgv[dn]dc.d.sde.gc...t |
| 2236 | 21 | $10^{-25}$ | c...[eq]f.c..?s..c[ilv]..[dn]w[ilv]cdgvndc.d.sde.gc...t |

| | | | |
|---|---|---|---|
| 2217 | 20 | $10^{-26}$ | c...[eq]f.c..?s..c[ilv]..[dn]w[ilv]cdgvndc.d.sde.gcp..t |
| 2226 | 19 | $10^{-28}$ | c.[as].[eq]f.c..?sg.cv..[dn]w[ilv]cdgvndc.d.sde[ast]gc...t |
| 2187 | 18 | $10^{-29}$ | c.[as].[eq]f.c..?sg.cv..[dn]w[ilv]cdgvndc.d.sde[st]gcp..t |

Fam7 (SEQ ID NOS: 616-622)

CLSSEFTCGNGNCIPRPWVCDGDNDCVDDSDE-KGCPEPT

CLANQFKCDNGRCIPQTWVCDGDNDCLDGSDEPVHCAKRT

CLANQFKCDNGRFIPQTWVCDGDNDCLDGSDEPVHCAKRT

CLANQFKCDNGRCIPQTWVCDGDNDCLDGSDEPVHCAKRT

CLANQFKCDNGRCIPQTWVCDGDNDCLDGSDEPVRCAKRT

CLANQFKCDNGRCIPQTWVCDGDNDCLDGSDEPVHCAERT

CLSSEFTCGNGNCIPQTWVCDGDNDCLDGSDEPVHCAKRT

| score | matches | expected | motif (SEQ ID NOS: 623-626) |
|---|---|---|---|
| 1319 | 11 | $10^{-29}$ | cl[as].[eq]f.c.ng..ip[kqr].wvcdgdndc[ilv]d.sde.?...c.[ekq].t |
| 1258 | 10 | $10^{-30}$ | cl[as].[eq]f.c.ng.cip[kqr].wvcdgdndc[ilv]d.sde.?...c.[ekq].t |
| 1286 | 9 | $10^{-36}$ | cl[as].[eq]f.c.ng..ipqtwvcdgdndcldgsde.?v.ca[ekq]rt |
| 1299 | 8 | $10^{-41}$ | clanqfkcdngr.ipqtwvcdgdndcldgsde.?v.ca[ekq]rt |

IL-6-binding dimers included the following (SEQ ID NOS:627-781). Dimers are not organized by family.

CLPNQFQCRSGQCIPRPWVCDGDNDCGDDSDEANCKAPVHTCLPSQFQCGSGYCISQRWVCDGENDCEDSSDEANCGRTEPT

CLSSEFTCGNGNCIPRPWVCDGDNDCVDDSDEKGCPEPTCLPSQFQCGSGYCISQRWVCDGENDCEDSSDEANCAGSVPT

CLSSQFQCSNGWCIPAAWLCDSDNDCGDDSDETSCPAPTCPSSQFQCSSGWCIPEDWRCDGVPDCGDGSDEASDHCGDSHILPFSTPGPST

CLASEFQCRNGSCIPLQWLCDGDNDCGDDSDEENCATTERTCLPSQFQCGSGYCISQRWVCDGENDCEDSSDEANCAGSVPT

CLSSEFTCGNGNCIPRPWVCDGDNDCVDDSDEKGCPEPTCPSSQFQCSSGWCIPEDWRCDGVPDCGDGSDEASDHCGDSHILPFSTPGPST

CGASQFQCHNTSICIPRPFVCDGDNDCGDDSDEADCKTSGHTCLPSQFQCGSGYCISQRWVCDGENDCEDSSDEANCAGSVPT

CLSSEFTCGNGNCIPRPWVCDGDNDCVDDSDEKGCPEPTCLPDQFQCGSGYCLPQRWVCDGVDDCEDSSDEKGCTPHT

CPSSQFQCGSGYCISPAWVCDGVNDCEDGSDEKSCAPHTCLPDQFQCGSGYCLPQAWVCDGENDCEDGSDETNCPART

CAPSQFTCGNGNCVPRPWLCDGDNDCEDDSDETSCPPHTCLPDQFQCGSGYCLPQAWVCDGENDCEDGSDETNCPAR

T

CAPSQFTCGNGNCVPRPWLCDGDNDCEDDSDETSCPXHTCLPDQFQCGSGYCLPQAWVCDGENDCEDGSDETNCPAR

T

CLPSQFQCGSGYCISQRWVCDGENDCEDSSDEANCAGSVPTCRPGQFQCGSGYCIPRPWRCDGDNDCEDDSDEKGCA

RSEPT

CLPSQFQCRNGRCIPLPWLCDGDNDCEDDSDETNCTPRTCAPSQFQCGSGYCIPLTWVCDGVDDCEDGSDEEDCETA

APT

CLPSQFQCGSGYCISQRWVCDGENDCEDSSDEANCAGSVPTCRASQFQCGSGYCIPRPWLCDGVNDCEDGSDEADCQ

TRT

CVPSQFQCGSGYCISQRWVCDGENDCEDSSDEANCAGSVPTCLPDQFQCGSGYCLPQAWVCDGENDCEDGSDETNCP

ART

CLPSQFQCRNGRCIPLPWLCDGDNDCEDDSDETNCTPRTCAPNQFQCGSGYCVPAAWVCDGENDCEDNSDESSALCQ

ERT

CAPSQFTCGNGNCIPRPWLCDGDNDCEDDSDETSCPXPTCLPDQFQCGSGYCLPQAWVCDGENDCEDGSDETNCPAR

T

CLSSEFTCGNGNCIPRPWVCDGDNDCVDDSDEKGCPEPTCVPSQFQCGSGYCISQRWVCDGENDCEDSSDEANCAGS

VPT

CAPNQFQCGSGYCVPAAWVCDGENDCEDNSDESSALCQERTCLPSQFQCGSGYCISQRWVCDGENDCEDSSDEANCA

GSVPT

CGANEFQCGSGYCLPVGWVCDGEWDCEDNSDEKGCPPHTCLPNQFQCRNGRCIPLPWLCDGDNDCEDDSDATNCTPR

T

CAPNQFQCGSGYCVPAAWVCDGENDCEDNSDESSALCQERTCVPSQFQCGSGYCISQRWVCDGENDCEDSSDEANCA

GSVPT

CLPDQFQCGSGYCLPQRWVCDGVDDCEDSSDEANCAGSVPTCLPDQFQCGSGYCLPQAWVCDGENDCEDGSDETNCP

ART

CAPSQFQCGSGYCIPLTWVCDGVDDCEDGSDEEDCETAAPTCLPSQFQCGSGYCISQRWVCDGENDCEDSSDEANCA

GSVPT

CLPSQFQCRNGRCIPLPWLCDGDNDCEDDSDETNCTPRTCLPSQFQCGSGYCISQRWVCDGENDCEDSSDEANCAGS

VPT

CAPSQFTCGNGNCVPRPWLCDGDNDCEDDSDETSCPPHTCAPNQFQCGSGYCVPAAWVCDGENDCEDNSDESSALCQ

ERT

CLPSEFQCHSTSICVPRQWLCDGDNDCGDDSDEKGCETHTCVPSQFQCGSGYCISQRWVCDGENDCEDSSDEANCAG

SVPT

CPPDQFQCGSGYCLPQAWVCDGENDCEDGSDETNCPARTCLSSEFTCGNGNCIPRPWVCDGDNDCVDDSDEKGCPEP

T

CAPSQFTCGNGNCVPRPWLCDGDNDCEDD

-continued

T

CAPSQFQCGSGYCIPLTWVCDGVDDCEDGSDEEDCETAAPTCLPDQFQCGSGYCLPQAWVCDGENDCEDGSDETNCP

ART

CAPNQFQCGSGYCVPAAWVCDGENDCEDNSDESSALCQERTCLSSQFQCDNGNCVPQQWVCDGDNDCLDDSDETSCS

APASEPPGSL

CLSSEFTCGHGICIPRPWVCDRDNDCMYHSHEISCPEPTCLPDQFQCGSVYCLPERLVCDCLNDCEDSSDEAXCAGS

XPT

CLPSQFQCRNGRCIPLPWLCDGDNDCEDDSDETNCTPRTCVPSQFQCGSGYCISQRWVCDGENDCEDSSDEANCAGS

VPT

CVPSQFQCGSGYCISQRWVCDGENDCEDSSDEANCAGSVPTCGWWGSSEFRCATYPHGRCIPSSXVCDGEDDCGDGS

DEHEVFCGGGG

CAPSQFQCGSGYCIPLTWVCDGVDDCEDGSDEEDCETAAPTCLPSEFQCHSTSICVPRQWLCDGDNDCGDDSDEKGC

ETHT

CVPSQFQCGSGYCISQRWVCDGENDCEDSSDEANCAGSVPTCLSSEFTCGNGNCIPRPWVCDGDNDCVDDSDEKGCP

EPT

CLPSEFQCHSTSICVPRQWLCDGDNDCGDDSDEKGCETHTCLASQFTCRNGNCIPEPWVCDGDNDCVDDSDEESCPP

HT

CEADQFQCGSGYCLPRHWVCDGDNDCEDDSDETDCGRPGPGATSAPAVSGGSGGSGGSCGS

CRASQFQCGSGYCIPRPWLCDGVNDCEDGSDEADCQTRTCVPSQFQCGSGYCISQRWVCDGENDCEDSSDEANCAGS

VPT

CAPNQFQCGSGYCVPAAWVCDGENDCEDNSDESLAHCQAHTCVSSEFRCSSGQCIPPPWRCDGVDDCADNSDEAGCT

PPT

CQPGQFPCGSGSCVSERLLCDGVDDCADGSDEAGCPPRTCVPSQFQCGSGYCISQRWVCDGENDCEDSSXEANCAGS

VPT

CHATAQFECSSGQCISLDWLCDGVNDCADGSDESQHCPPRTCVPSQFQCGSGYCISQRWVCDGENDCEDSSDEANCA

XSVPT

CEASQFPCRNSERCVPPHLLCDGVNDCADGSDEIGCPPHTCVPSQFQCGSGYCISQRWVCDGENDCEDSSDEANCAG

SVPT

CPSNQFQCRNNGTCIPLPWLCDGVDDCGDDSDETSCTEPTCVPSQFQCGSGYCISQRWVCDGENDCEDSSDEANCAG

SVPT

CQSSEFTCSSGRCLSAGWLCDGVNDCRDDSDEESCTAPVPTCVPSQFQCGSGYCISQRWVCDGENDCEDSSDEANCA

GSVPT

CQPGQFQCHDYGRCVSQNWLCDGDPDCLDSSDEANCQPPTCVPSQFQCGSGYCISQRWVCDGENDCEDSSDEANCAG

SVPT

CPAGQFQCRTGRCIPLALLCDGENDCQDGSDEAGCPTPTCVPSQFQCGSGYCISQRWVCDGENDCEDSSDEANCAGS

VPT

CGAGEFPCDNGRCVPAALLCDGDDDCGDNSDEKDCAQPTCVPSQFQCGSGYCISQRWVCDGENDCEDSSDEANCAGS

VPT

CRSSEFRCDSGHCLPLPWVCDGDDDCEDGSDEAQDCEPRTCVPSQFQCGSGYCISQRWVCDGENDCEDSSDEANCAG

SVPT

-continued

CRSNQFQCGSGYCIPVKWLCDGENDCEDGSDESLAHCQAHTCVASQFRCDNGRCLSEPLGCDGVNDCPDNSDEEDCT
TAEHT

CRADQCQCNSGHCLSRNLRCDGEDDCADNSDEKSCSQDPEFHKVCLPDQFQCGSGYCLPQRWVCDGVDDCEDSSDEK
GCTPHT

CLPSQFQCGSGYCISQRWVCDGENDCEDSSDEANCAGSVPTCRSSQFQCGNGRCISVHWVCDGDDDCEDSSDESSAH
CKPRT

CPSNEFRCNNGHCIPRAWRCDGDNDCGDSSDETDCTQRTCRSNQFQCGSGYCISQRWVCDGENDCEDSSDEANCAGS
VPT

CPADEFPCKNGKCLPLPWVCDGDNDCADNSDETDCTATAPTCRSNQFQCGSGYCISQRWVCDGENDCEDSSDEANCA
GSVPT

CGSDEFLCNNGKCIPPTWGCDGVNDCQDNSDEAPALCPPPTCRSNQFQCGSGYCIPQRWVCDGVDDCEDSSDEKGCT
PHT

CAPNQFQCGSGYCVPAAWVCDGENDCEDSSDEANCAGSVPTCRSGQFQCGSGYCISQRWXCDGENDCEDSSDEANCA
GSVPT

CLPGQFQCGSGYCISQRWVCDGENDCEDSSDEANCAGSVPTCRPSQFPCSNGQCVPQTWVCDGVNDCQDDSDETDCS
APASEPPGSL

CLPSQFQCGSGYCISQRWVCDGENDCEDSSDEANCAGSVPTCRPSEYPCGNGRCVPQPLRCDGVNDCEDSSDEANCT
PHT

CRSNQFQCGSXYCIPVKWLCDGENDCEDGSDEADCAGSVPTCRPDQFPCDNGNCIPGPWGCDGVNDCLDSSDETDCT
PPT

CPSSQFKCNNGSCVPQDWLCDGVNDCVDGSDEPAVCQQRTCRASQFQCGSGYCIPRPWLCDGVNDCEDGSDEADCQT
RA

CASGEFRCGNGRCVPQRWLCDGVPDCEDNSDETDCQPPTCRASQFQCGSGYCIPRPWLCDGVDDCEDSSDEKGCTPH
T

CLPSQFQCGSGYCIPQRWVCDGENDCEDSSDEANCAGSVPTCQSSEFPCSSGHCLPLALGCDGEDDCADNSDEESCE
PRT

CRASQFQCGSGYCIPRPWLCDGVNDCEDSSDEANCAGSVPTCQPSQFRCRSGHCISGALGCDGEPDCGDGSDETGCR
ASAHT

CLPSQFQCGSGYCISQRWVCDGENDCEDSSDEANCAGSVPTCQPDQFRCGSGPLRSTALACDGXKXLSGQLGXKKAV
EPPDRT

CLPSQFQCGSGYCISQRWVCDGENDCEDSSDEANCAGSVPTCQAGEFRCGNGRCLPPDWRCDGVDDCGDGSXEASCK
TPT

CQSDEFTCRDSNKCVSRDWLCDGEDDCPDGSDETSCAGSERTCPSSQFQCSSGWCIPEDWRCDGVPDCGDGSDEASC
PPHT

CVPSQFQCGSGYCISQRWVCDGENDCEDSSDEANCAGSVPTCPSNEFPCESGHCVPLTWRCDGEDDCPDSSDEANCG
RPGPGATSVPAA

CRSNQFQCGSGYCLPQAWVCDGENDCEDGSDETNCPARTCPSGQFRCDNGKCLSEAWVCDGVDDCRDGSXESEHCAP
PT

CRSNQFQCGSGYCISQRWVCDGENDCEDSSDEANCAGSVPTCPSGQFQCRGTGKCIPQPWVCDGDNDCQDDSDEKDC
SAPASEPPGSL

-continued

CLPSQFQCGSGYCISQRWVCDGENDCEDSSDEANCAGSVPTCPSGEFRCGNGSCLPAGWVCDGVDDCVDGSDEKGCQTPT

CVPSQFQCGSGYCISQRWVCDGENDCEDGSDEANCAGSVPTCPSDEFRCRNGRCIPRAWRCDGXNDCADNSDEEDCTEHT

CVPSQFQCGSGYCISQRWVCDGENDCEDGSDEANCAGSVPTCPSDEFRCRNGRCIPRAWRCDGVNDCADNSDEEDCTEHT

CRSNQFQCGSGYCIPVKWLCDGENDCEDSSDEESCPXRTCPPSEFRCKGSGKCVPQHWLCDGVNDCEDDSDEKSCPPPT

CRSNQFQCGSGYCIPVKWLCDGENDCEDSSDEESCPARTCPPSEFRCKGSGKCVPQHWLCDGVNDCEDDSDEKSCPPPT

CLSSEFQCGSGYCISQRWVCDGENDCEDSSDEANCAGSVPTCPADEFRCSSGRCVPATWLCDGVDDCEDSSXESLETCTPHT

CRSNQFQCGSGYCIPVKWLCDGENDCEDGSDEADCQTRTCLSSEFQCSNGQCVSQRLLCDXVDDCLDDSDEEDCSAPASEPPGSL

CQANQFRCNNGRCLSPAWLCDGVDDCPNGSDEEGCPPHTCLSSEFQCGSXYCISQRWVCDXENDCEDSSDEANCAGSVPT

CESGEFTCGSGQCLPATWRCDGDNDCADDSDETNCPQPTCLSSEFQCGSGYCISQRWVCDGENDCEDSSDEANCAGSVPT

CPPGQFRCRSGNCLPQTWVCDGDDDCEDDSDESPALCSQDPEFHKVCLPSQFQCGSVYCISQRWVRDGXNDCEDSSDEANCAGSVPT

CQSGQFPCGNGNCIPRPLRCDGVDDCPDGSDEPPECPQPTCLPSQFQCGSGYCISRRWVCDGENDCEDSSDEKGCTPHT

CQPDEFTCHDKNRCISLALLCDGVNDCEDDSDEEGCAPRTCLPSQFQCGSGYCISQRWVCDXENDCEDSSDEANCAGSVPT

CVSSQFKCSNGRCLPLGWLCDGVDDCADGSDEKNCPPPTCLPSQFQCGSGYCISQRWVCDXENDCEDSSDEADCAGSVPX

CVPNQFPCGNGHCLPRDWLCDGVNDCGDSSDESPAHCTEPTCLPSQFQCGSGYCISQRWVCDGENDCEDSSXXANCAGSVPT

CRAGQFRCSSGHCLPRRLLCDGEDDCVDGSDETGCTQRTCLPSQFQCGSGYCISQRWVCDGENDCEDSSDEKGCTPHT

CQPNQFRCSNGRCVPLNLLCDGVPDCEDGSDEEGCPPRTCLPSQFQCGSGYCISQRWVCDGENDCEDSSDEANCAGSVPT

CRSSQFRCSSGQCVSLGWVCDGVNDCPDSSDETGCPKRTCLPSQFQCGSGYCISQRWVCDGENDCEDSSDEANCAGSVPT

CHAIAQFGCKSGRCLSLGLLCDGVDDCADGSDEAGCPTRTCLPSQFQCGSGYCISQRWVCDGENDCEDSSDEANCAGSVPT

CPPSQFTCSNGNCLSPTLLCDGVNDCVDDSDETSCAASVHTCLPSQFQCGSGYCISQRWVCDGENDCEDSSDEANCAGSVPT

CLADQFKCHNTNICIPGRLGCDGDPDCEDDSDEKGCPPHTCLPSQFQCGSGYCISQRWVCDGENDCEDSSDEANCAGSVPT

-continued

CPPGEFPCSSGHCLSQALRCDGVPDCEDDSDETGCPPPTCLPSQFQCGSGYCISQRWVCDGENDCEDSSDEANCAGSVPT

CGANEFTCGNGRCLSPTWLCDGDDDCGDNSDEASCGGTAPTCLPSQFQCGSGYCISQRWVCDGENDCEDSSDEANCAGSVPT

CLPNEFPCGSGHCIPQAWVCDGENDCQDSSDEAPAHCAAPVPACLPSQFQCGSGYCISQRWVCDGENDCEDSSDEANCAGSVPT

CPPSQFKCSNGRCLPVQLLCDGVPDCPDGSDETGCPPPTCLPSQFQCGSGYCISQRWVCDGENDCEDSSDEANCAGSVPT

CLASQFRCGNGSCLSQTLLCDGVWDCADNSDEVSCPPPTCLPSQFQCGSGYCISQRWVCDGENDCEDSSDEANCAGSVPT

CLPSQFQCGSGYCISQRWVCDGENDCEDGSDEESCTGPGHTCLPSQFQCGSGYCISQRWVCDGENDCEDSSDEANCAGSVPT

CPPGEFQCNSGHCLPGTWGCDGEDDCPDGSDESQDCAPPTCLPSQFQCGSGYCISQRWVCDGENDCEDSSDEANCAGSVPT

CPSSEFKCNNGQCLPVRWLCDGVNDCLDSSDEASCAARTCLPSQFQCGSGYCISQRWVCDGENDCEDSSDEANCAGSVPT

CHPPSQFRCSNGQCLPLTWRCDGVNDCGDNSDEEDCPERTCLPSQFQCGSGYCISQRWVCDGENDCEDSSDEANCAGSVPT

CLANEFRCSSGQCIPARWLCDGVNDCVDDSDEKDCPARTCLPSQFQCGSGYCISQRWVCDGENDCEDSSDEANCAGSVPT

CLPGQFRCHSTDTCLPESWVCDGVNDCADDSDEASCPPHTCLPSQFQCGSGYCISQRWVCDGENDCEDSSDEANCAGSVPT

CLSSQFRCDSGRCISQDWLCDGVNDCQDGSDESLAICPPHTCLPSQFQCGSGYCISQRWVCDGENDCEDSSDEANCAGSVPT

CPAGQFTCGSGKCVSGGLLCDGDNDCQDGSDEAGCATRTCLPSQFQCGSGYCISQRWVCDGENDCEDSSDEANCAGSVPT

CAPDQFKCGNGNCLPLPWVCDGDNDCGDNSDEANCPQHTCLPSQFQCGSGYCISQRWVCDGENDCEDSSDEANCAGSVPT

CAPSQFRCESGQCLPANWRCDGENDCQDGSDESPAICEGTAPTCLPSQFQCGSGYCISQRWVCDGENDCEDSSDEANCAGSVPT

CPSNQFTCRSGSCLSLAWLCDGVNDCPDNSDEADCAERTCLPSQFQCGSGYCISQRWVCDGENDCEDSSDEANCAGSVPT

CPSSEPPCHGNSRCIPLTWLCDGDNDCGDDSDEKNCEAAGPTCLPSQFQCGSGYCISQRWVCDGENDCEDSSDEANCAGSVPT

CQPSQFRCGNGHCLPPTLVCDGENDCRDNSDETSCATAVRTCLPSQFQCGSGYCISQRWVCDGENDCEDSSDEANCAGSVPT

CRADEFRCSSGHCIPAPWGCDGVNDCEDGSDEAGCPARTCLPSQFQCGSGYCISQRWVCDGENDCEDSSDEANCAGSVPT

CAANEFRCRSTNTCIPQQWLCDGVNDCQDDSDEKSCRTPAPTCLPSQFQCGSGYCISQRWVCDGENDCEDSSDEANCAGSVPT

-continued

CAPSQFPCSSNDICVPRRWRCDGVDDCGDSSDEASCGTSVRTCLPSQFQCGSGYCISQRWVCDGENDCEDSSDEANCAGSVPT

CLPDQFPCSNGRCLPPTWVCDGENDCQDGSDEADCTEPTCLPSQFQCGSGYCISQRWVCDGENDCEDSSDEANCAGSVPT

CLPNQFRCRNGQCLPQNWLCDGVNDCGDSSDETNCEPHTCLPSQFQCGSGYCISQRWVCDGENDCEDSSDEANCAGSVPT

CQPSQFQCNNGHCLSVRWLCDGVDDCQDGSDETDCPTRTCLPSQFQCGSGYCISQRWVCDGENDCEDSSDEANCAGSVPT

CRSNEFTCSSGSCXPLAWVCDGVNDCLDDSDEAGCPAPTCLPSQFQCGSGYCISQRWVCDGENDCEDSSDEANCAGSVPT

CLSGEFKCNSGHCIPGPWLCDGDDDCPDGSDETDCGSPGPTCLPSQFQCGSGYCISQRWVCDGENDCEDSSDEANCAGSVPT

CPADQFRCSNGRCIPRTWVCDGVDDCGDGSDESPLCESAAHTCLPSQFQCGSGYCISQRWVCDGENDCEDSSDEANCAGSVPT

CVPSQFQCRNNGICIPQNWHCDGVPDCEDSSDEESCGTTVHTCLPSQFQCGSGYCISQRWVCDGENDCEDSSDEANCAGSVPT

CLPSEFPCDSGQCLPLAWLCDGVDDCRDSSDESLEICPKHTCLPSQFQCGSGYCISQRWVCDGENDCEDSSDEANCAGSVPT

CPPGEFKCNSGNCVSPTWGCDGVDDCGDDSDEASAICEAPEHTCLPSQFQCGSGYCISQRWVCDGENDCEDSSDEANCAGSVPT

CPPGQFPCSNGRCVPQRLRCDGDPDCEDNSDEAGCATPEPTCLPSQFQCGSGYCISQRWVCDGENDCEDSSDEANCAGSVPT

CVANEFRCGNGHCVPLAWLCDGVPDCVDDSDETSCQARTCLPSQFQCGSGYCISQRWVCDGENDCEDSSDEANCAGSVPA

CQPGEFRCRNGRCLPLAWLCDGVDDCVDGSDETNCAARTCLPSQFQCGSGYCIPQRWVCDGENDCEDSSDEANCAGSVPT

CGASEFRCDSGHCISPDWRCDGDNDCVDGSDEKSCEQRTCLPSQFQCGSGYCFSQRWVCDGENDCEDGSDEANCAGSVPT

CRADEFTCNNGRCVPQTWVCDGDPDCEDSSDEKGCTASVHTCLPSQFQCGSGYXISXXXVCXXENDCEDSSDEANCAGSVPT

CLPSQFQCGSGYCISQRWVCDGENDCEDSSDEANCAGSVPTCLPSEFQCGNGRCLPLRLLCDGDDDCGDNSDEPLATCETSAPT

CRSNQFQCGSGYCISQRWVCDGENDCEDSSDEANCAGSVPTCLPGQFRCNSGQCLPLQWACDGVDDCADNSDEASCEPPT

CAAGQFQCHSTSRCVSLRWVCDGEDDCRDGSDEEGCTTAVPTCLPDQFQCGSGYCLPQRWVCDGVDDCEDSSDEKGCTPHT

CPPSQFPCNSGNCVSAAWVCDGVDDCGDDSDESLAICPTSTCLPDQFQCGSGYCLPQRWVCDGVDDCEDSSDEKGCTPHT

CRASEFRCRSYERCISPRWVCDGVNDCGDNSDETGCPPRTCLPDQFQCGSGYCLPQRWVCDGVDDCEDSSDEKGCTPHT

-continued

CPLDQFTCGNGSCLPANLLCDGVNDCEDNSDEAGCPTRTCLPDQFQCGSGYCLPQRWVCDGVDDCEDSSDEKGCTPHM

CPAGQFPCDSGRCVPQPWRCDGVNDCEDGSDEAPATCPEHTCLPDQFQCGSGYCLPQAWVLRXRKXLXGQLGXSKTVQAPYLT

CRPSQFQCQNSSRCIPLGWRCDGDNDCEDGSDEKDCTATARTCLPDQFQCGSGYCLPQAWVCDGENDCEDGSDETNCPART

CLANQFRCGNGRCVSPSWLCDGVDDCGDDSDEASCAAAEPTCLPDQFQCGSGYCLPQAWVCDGDNDCEDGSDETNCPART

CRPNQFPCGNGHCLPGRWLCDGDDDCPDGSDEEGWPPPTCLPDQFQCGSGYCLPQRWVCDGVDDCEDSSDEKGCTPHT

CPANEFTCDNGHCLPPSLLXDGENDCGDDSDETSCAAPGPTCLPSQFQCGSGYCISQRWVCDXENDCEDSSXEANCAGSVPT

CRSSQFTCNSGSXLPGHLVCDGVDDCEDNSDEENCAGPGRTCLSSEFQCGSGYCISQRWVCDXENDCEDSSNEANCAGSVPT

CQANEFTCSSGNCLSPALLXDGVDDCGDNSDETNCASPAPTCLPSQFQCGSGYCISQRWVCDGENDCEDSSDEANCAGSVPT

CEAGEFRCRNGSCIPEAWGCDGVNDYLDNSDETNCPAHTCLSSEFQCGSGYCISQRWVCDGENDCEDSSDEANCAGSVPT

CPSGQFRCDNGHCLSPPLLXDGVNDCGDDSDETGCTQRTCLPSQFQCGSGYCISQRWVCDGENDCEDSSDEANCAGSVPT

CPPSEFRCHSTNTCLSPTLLXDGDNDCGDGSDEASCPQRTCLPSQFQCGSGYCISQRWVCDGENDCEDSSDEANCAGSVPT

CVPDEFPCNSGQCVSLAWLCXGVNDCRDGSDEAPYWEPPTCLPSQFQCGSGYCISQRWVCDGENDCEDSSDEANCAGSVPT

CASNEFPCSNGNCIPGPLRCDGVNDCEDNSDESPLWPLHTCLPSQFQCGSGYCISQRWVCDGENDCEDSSDEANCAGSVPT

CQSDQFQCNSGSCIPPPWRXDGVDDCRDSSDEEGCPPRTCLPSQFQCGSGYCISQRWFCDXENDCEDSSXEANCAGSVPT

CEANQFPCNSGSCIPPRWLXDGVDDCGDNSDEENCTRPTCLPSQFQCGSAYCISQRWVCDGENDGEDSSDEANCAGSVPT

CLPSQFQCGSGYCISQRWVCDGENDCEDSSDEANCAGSVPTCGGSEFTCGNGRCLPQHWFCDGENDCLDDSDEAGCPAPT

CASDQFQCNGSRKCISQSWLCDGVNDCPDSSDEKSCPPHTCGANEFQCGSGYCLPRPWVCDGEDDCEDGSDESLAHCQAHT

CPANQFRCGNGSCLSANWLCDGVNDCLDNSDEKNCGGAGHTCGANEFQCGSGYCLPRPWVCDGEDDCEDGSDESLAHCQAHT

CPSGQFRCGSGRCIPQHWRCDGDDDCRDGSDEASCAPPTCAPSQFQCGSGYCISQRWVCDGENDCEDSSDEANCAGSVPT

CQPFDEFECRNGSCIPLPWRCDGVNDCLDDSDEEDCTGSAPTCAPSQFQCGSGYCIPQRWVCDGVDDCEDSSDEKGCTPHT

-continued

CHPPNKFGCSNGRCVSPALLCDGVDDCQDNSDEKGCPPHTCAPNQFQCGSGYCVPAAWVCDGENDCEDSSDEKGCTP
HT

CLPGQFRCNSGRCVPVVLVCDGVDDCADDSDEAGCPPPTCAPNQFQCGSGYCVPAAWVCDGEWDCEDSSDEANCAGS
VPT

CAPGQFPCGNGQCLPLHWVCDGVNDCGDNSDEAGCPPHTCAPNQFQCGSGYCVPAAWVCDGENDCEDNSDESSALCQ
ERT

CPPNQFPCGSGQCLPQPLVCDGDDDCGDGSDELQLCEQPTCAPNQFQCGSGYCVPAAWVCDGENDCEDNSDESSALC
QERT

CRSNQFQCGSGYCIPVKWLCDGENDCVDGSDEESCPARTCAPDEFRCDSGRCVPRTLGXATGDDDCEGRARMKKTVE
RPNPT

CRANQFQCGSGYCIPRPWLCDGENDCEDGSDETNCPARTCAANEFTCGNGHCLPPTWACDGVNDCQDGSDEASCQTP
T

The following lists IL-6-binding trimers, listed by families of related sequences. Note that the family numbers for monomers are not related to family numbers for trimers.

Fam1 (SEQ ID NOS: 782-788)

CRASQFQCGSGYCIPRPWLCDGDNDCEDDSDETNCTP-------RTCLPDQFRCG-NGQCIPLDWVCDGVNDCADNSDEAGC--PPRTCLPSQFQCGSGYCIS
QRWVCDGENDCRDSSDEANCAGSVPT

CLPDQFPCENGKCLPVNLVCDGDDDCPDGSDESEVCAGAV----RTCLPDQFRCG-NGQCIPLDWVCDGVNDCADNSDETGC--PTRTCLPSQFQCGSGWCIS
QRWVCDGENDCEDSSDEANCAGSVPT

CLSSQFQCDNGNCVPQQWVCDGDNDCLDDSDETSCSAPASEPPGSLCPASQFPCS-SGHCVPLNWVCDGVNDCVDGSDEAGC--PPRTCLPDQFQCGSGYCIS
QRWVCDGENDCEDSSDEANCAGSVPT

CQASEFPCDSGQCIPQPLGCDGDNDCADNSDEESCQPRT-------CPASQFPCS-SGHCVPLNWVCDGVNDCVDGSDEAGC--PPRTCLPDQFQCGSGYCIS
QRWVCDGENDCEDSSDEANCAGSVPT

CLPNQFTCDSGNCVPQALGCDGDNDCEDNSDESPALCAAP---AHTCQANEFTCS-SGNCLSPALLCDGVDDCGDNSDETYCAGPAPTCLPSQFRCGSGCCFS
QRWVCDGKNDCEDSSDEANCAGSLPT

CLPNEFTCDSGNCVPQALGCDGDNDCEDNSDESPALCAAP---AHTCQANEFTCS-SGNCLSPALLCDGVDDCGDNSDETYCASPAPTCLPSQFQCGSGYCIS
QRWVCDGENDCEDSSDEANCAGSVPT

CGASQFQCGSGYCISQRWVCDGENDCEDSSDEANCAGSVP-----TCLPSEFQCRDSKICLSADWLCDGVNDCADNSDEEGC--PPPTCLPDQFQCGSGYCLP
QAWVCDGENDCEDGSDETNCP--ART

| score | matches | expected | motif (SEQ ID NOS: 789-791) |
| --- | --- | --- | --- |
| 2137 | 7 | $10^{-84}$ | c...[eq]f.c..g.c[ilv].....cdg[de][dn]dc.d.sde......?.?.?.?.?.?.?.?.?c...[eq]f.c..?...c[ilv]....[ilv]cdgv[dn]dc.d.sde..c.?.?p..tclp.qf[kqr]cgsg.c[filmv].q.wvcdg[ekq]ndced.sde[ast]nc..?.?..t |
| 2043 | 6 | $10^{-95}$ | c...[eq]f.c..g.c[ilv]p....cdgd[dn]dc.d.sde......?.?.?.?.?.?.?.?.?c...[eq]f.c..?.g.c[ilv]....[ilv]cdgv[dn]dc.d.sde[ast].c.?.?p..tclp.qf[kqr]cgsg.c[filmv]sqrwvcdg[ekq]ndcedssdeanca.?.?]ilv]pt |
| 1757 | 5 | $10^{-98}$ | c...[eq]f.c..g.c[ilv]p....cdgd[dn]dc.d.sde......?.?.?.?.?.?.?.?.?c...[eq]f.c..?.g.c[ilv]....[ilv]cdgv[dn]dc.d.sde[ast].c.?.?p..tclp.qfqcgsg[fwy]cisqrwvcdgendcedssdeanca.?.?vpt |

Fam2 (SEQ ID NOS: 792-813)

CLPDQFRCGNGQCIPLDWVCDGVNDCEDSSDEAGCPP--RTCLPDQFQCGSGYCLPQRWVCDGVDDCEDSSDRKGCTPHT--CLSDQFQCGSGHCLPASWRCD
GEDDCADSSDETSCTASEPT

CLPDQFRCGNGQCIPLDWVCDGVNDCEDDSDEESCPP--RTCLPDQFQCGSGYCLPQRWVCDGVDDCEDSSDEKGCTPHT--CEPGQFPCESGQCLPPPWVCD
GVNDCADNSDEEDCGDSHILPFSTPGPST

CLPSQFQCRNGRCIPLPWLCDGDNDCEDDSDETNCTP--RTCPSSQFQCSSGWCIPEDWRCDGVPDCGDGSDEASDHC

-continued

```
CPSSQPRCSSGRCVPADWLCDGVNDCADNSDETGCPT--RTCLPSQFQCGSGYCISQRWVCDGENDCEDSSDEANCAGSVPTCPSDEFRCRNGRCIPRAWRCD
GVNDCADNSDEEDCTEH--T

CPSSQFRCSSGRCVPADWLCDGVNDCADNSDETGCAT--RTCLPSQFQCGSGYCISQRWVCDGENDCEDSSDEANCAGSVPTCPSDEFRCRNGRCIPRAWRCD
GVNDCADNSDEEDCTEH--T

CPSSQFRCSSGRCVPADWLCDGVNDCGDNSDEAGCPT--RTCLPSQFQCGSGYCISQRWVCDGENDCEDGSDEANCAGSVPTCPSDEFRCRNGRCIPRAWRCD
GVNDCADNSDEEDCTEH--T

CPSDEFTCDSGRCVSLNWLCDGVNDCGDNSDEAGCPT--RTCLPSQFQCGSGYCISQRWVCDGENDCEDGSDEANCAGSVPTCPSDEFRCRNGRCIPRAWRCD
GVNDCADNSDEEDCTEH--T

CPSDEFTCDSGRCVSLNWLCDGVNDCGDNSDEAGCPT--RTCLPSQFQCGSGYCISQRWVCDGENDCEDGSDEANCAGSVPTCPSDEFRCRNGRCIPRAWRCD
GVNDCADNSDREDCTEH--T

CLPDQFRCGNGQCIPLDWVCDGVNDCEDDSDEESCPP--RTCLPDQFQCGSGYCLPQRWVCDGENDCEDGSDEANCAGSVPTCPSDEFRCRNGRCIPRAWRCD
GVNDCADNSDEEDCTQH--T

CLPDQFRCGNGQCIPLDWVCDGVNDCEDDSDEESCPP--RTCLPDQFQCGSGYCLPQRWVCDGENDCEDGSDEANCAGSVPTCPSDEFRCRNGRCVPRAWRCD
GVNDCADNSDEEDCTEH--T

CLPDQFRCGNGQCIPLDWVCDGVNDCEDDSDEESCPP--RTCLPDQFQCGSGYCLPQRWVCDGENDCEDGSDEANCAGSVPTCPSDEFRCRNGRCIPRAWRCD
GVNDCADNSDEADCAAP--T

CLPDQFRCGNGQCIPLDWVCDGVNDCEDDSDEESCPP--HTCLPDQFQCGSGYCLSQRWVCDGENDCEDGSDEANCAGSVPTCPSDEFRCRNGRCIPRAWRCD
GVNDCADNSDEEDCTEH--T

CLPDQFRCGNGQCIPLDWVCDGVNDCEDDSDEESCPP--RTCLPDQFQCGSGYCISQRWVCDGENDCEDGSDEANCAGSVPTCPSDEFRCRNGRCIPRAWRCD
GVNDCADNSDEEDCTEH--T

CLPDQFRCGNGQCIPLDWVCDGVNDCPDDSDSSGCPP--RTCAPSQFQCGSGYCISQRWVCDGENDCEDGSDEANCAGSVPTCPSDEFRCRNGRCIPRAWRCD
GVNDCADNSDEEDCTEH--T

CLPDQFRCGNGQCIPLDWVCDGVNDCADNSDETGCPT--RTCLPSQFQCGSGYCISQRWVCDGENDCEDGSDEANCAGSVPTCPSDEFRCRNGRCIPRAWRCD
GVNDCADNSDEEDCTEH--T

CLPDQFRCGNGQCIPLDWVCDGVNDCADNSDETGCPT--RTCLPSQFQCGSGYCISQRWVCDGENDCEDGSDEANCAGSVPTCPSDEFRCRNGRCIPRAWRCD
GVNDCADNSDEEDCTEN--T

CESDQFQCDSGHCVPLNWVCDGVNDCVDGSDEAGCPP--RTCLPGQFQCGSGYCISQRWVCDGENDCEDGSDEANCAGSVPTCPSDEFRCRNGRCIPRAWRCD
GVNDCADNSDEEDCTEH--T

CEANELRCSSGRCLSVHWLCDGVDDCEDSSDEAGCPP--RTCLPDQFQCGSGYCLPQRWVCDGENDCEDGSDEANCAGSVPTCPSDEFRCRNGRCIPRAWRCD
GVNDCADNSDEEDCTEH--T

CGSNEFTCSNGRCIPPTLLCDGVNDCGDDSDETGCATPVRTCLPSQFQCGSGYCISQRWVCDGENDCEDGSDEANCAGSVPTCPSDEFRCRNGRCIPRAWRCD
GVNDCADNSDEEDCTEH--T

CRADEFQCGSGRCVPADWLCDGVNDCADNSDETGCPT--RTCLPSQFQCGSGYCISQRWVCDGENDCEDGSDEANCAGSVPTCPSDEFRCRNGRCIPRAWRCD
GVNDCADNSDEEDCTEH--T

CPSSQFRCSSGRCVPADWLCDGVNDCADNSDETGCPT--RTCLPSQFQCGSGYCISQRWVCDGENDCEDGSDEANCAGSVPTCPSDEFRCRNGRCIPPGWLCD
GVDDCVDDSDEEGCRTPART

CPSSQFRCSSGRCVPADWLCDGVNDCADNSDETGCPT--RTCLPSQFQCGSGYCISQRWVCDGENDCEDSSDEANCAGSVPTCPPGQFTCNNGRCVPPTWLCD
GEDDCQDDSDEKNCKAP-T
```

| score | matches | expected | motif (SEQ ID NOS: 814-819) |
|---|---|---|---|
| 8844 | 24 | $10^{-103}$ | c...[eq][fly].c...g.c[ilv]....[ilv]cdgv[dn]dc.d.sde...c....?.?.tc.p.qfqcgsgyc[ilv].qr wvcdgendced.sdeancagsvptcp..[eq]f.c.ngrc[iv]p..w.cdg.[dn]dc.d[dn]sde...c.....?.?t |
| 8963 | 23 | $10^{-110}$ | c...[eq][fly].c...g.c[ilv]....[ilv]cdgv[dn]dc.d.sde...c....?.?.tc.p.qfqcgsgyc[ilv].qr wvcdgendced.sdeancagsvptcpsdefrcrngrc[iv]p..w.cdgv[dn]dc.d[dn]sde...c....?.?t |
| 9119 | 22 | $10^{-117}$ | c...[eq][fly].c...g.c[ilv]....[ilv]cdgv[dn]dc.d.sde...c....?.?.tc.p.qfqcgsgyc[ilv].qr wvcdgendced.sdeancagsvptcpedefrcrngrc[iv]prawrcdgvndcadnsde.dc[ast]...?.?t |
| 8895 | 21 | $10^{-120}$ | c...[eq][fly].c...g.c[ilv]....[ilv]cdgv[dn]dc.d.sde...c....?.?.tc.p.qfqcgsgyc[ilv].qr wvcdgendced.sdeancagsvptcpsdefrcrngrc[iv]prawrcdgvndcadnsdeedct[eq]..?.?t |
| 8599 | 20 | $10^{-122}$ | c...[eq][fly].c...g.c[ilv]...w[ilv]cdgv[dn]dc.d.sde...c....?.?.tc.p.qfqcpsgyc[ilv].qr wvcdgendced.sdeancagsvptcpsdefrcrngrc[iv]prawrcdgvndcadnsdeedct[eq]..?.?t |
| 8309 | 19 | $10^{-124}$ | c...[eq]f.c.g.c[iv]..[dn]w[ilv]cdgvndc.d.sde...?.?.tc.p.qfqcgsgyc[ilv].qrwvcdge ndced.sdeancagsvptcpsdefrcrnprc[iv]prawrcdgvndcadnsdeedct[eq].?.?.t |

-continued

| Fam3 (SEQ ID NOS: 820-829) |
|---|
| CPSDEFTCDSG-RCVSLNWLCDGVNDCGDNSDEAGC--PTRTCLPSQFQCGSGYCISQRWVCDGENDCEDSSDEANCAGSVPT |
| CPSSQFRCSSG-RCVPADWLCDGVNDCADNSDETGCPT--RTCLPSQFQCGSGYCISQRWVCDGENDCEDGSDEANCAGSVPTCPSDEFRCRNGRCIPRAWRCDGVNDCGDSSDETSCSAPASEPPGS-L |
| CPSDEFTCDSG-RCVSLNWLCDGVNDCGDNSDEAGC--PTRTCLPSQFQCGSGYCISQRWVCDGENDCEDSSDEANCAGSVPTCGANEFTCDNGRCLSPDLVCDGVDDCADSSDETDCQ--KPM------ |
| CPSDEFTCDSG-RCVSLNWLCDGVNDCGDNSDEAGC--PTRTCLPSQFQCGSGYCISQRWVCDGENDCEDSSDEANCAGSVPTCPPDEFQCNSGSCLSQPLLCDGEDDCGDGSDEESCI--AAEHT---- |
| CLSDEFTCDSG-RCVSLNWLCDGVNDCGDNSDSAGC--PTHTCLPSQFQCGSGYCISQRWVCDGENDCEDSSDEANCAGSVPTCPASEFRCNNGRCIPAQWRCDGVNDCGDDSDEASCQ--APT------ |
| CQANEFTCSSG-NCLSPALLCDGVDDCGDNSDETNCASPAPTCLPSQFQCGSGYCISQRWVCDGENDCEDSSDEANCAGSVPTCPSDEFRCRNGRCIPRAWRCDGVNDCADNSDEEDCT--EHT------ |
| CELNEFTCSSG-NCLSPALLCDGVDDCGDNSDETNCASPAPTCLPSQFQCGSGYCISQRWVCDGENDCEDSSDEANCAGSVPTCPSDEFRCRNGRCIPRAWRCDGVNDCADNSDEANCAGSVPT------ |
| CQANEFTCSSG-NCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQ--PPT------ |
| CQANEFTCSSG-NCLSPALLCDGVDDCGDNSDETYCASPAPTCLPSQFQCGSGYCISQRWVCDGENDCEDSSDEANCAGSVPTCLSGEFTCENGNCLSLSVCDGEDDCEDGSDEASCP--PPT------ |
| CQANEFTCSSG-NCLSPALLCGDVDDCGDNSDETNCASPAPTCLPSQFQCGSGYCISQRWVCDGEHDCEDSSDEANCAGSVPTCAPGEFTCGSGRCVPQTWRCDGVDDCLDSSDETDCS-APASEPPGSL |

| score | matches | expected | motif (SEQ ID NOS: 830-832) |
|---|---|---|---|
| 3233 | 9 | $10^{-101}$ | c...[eq]f.c.sg.?.c[ilv]....lcdgv[dn]dc.dnsde[ast].c.?.?.?.?.tclpsqfqcgsgycisqrwvcdge.dced.sdeancagsvptc...ef.c..g.c[ilv].....cdg.[dn]dc.d.sde...c..?.?....?.?.?.?.? |
| 3001 | 8 | $10^{-105}$ | c..[dn]eftc.sg.?.c[ilv]s...lcdpv[dn]dcgnsde[ast].c.?.?.?.?.tclpsqfqcgsgycisqrwvcdge.dced.sdeancagsvptc...ef.c..g.c[ilv].....cdg.[dn]dc.d.sde...c..?.?....?.?.?.?.? |
| 2672 | 7 | $10^{-107}$ | c.[as][dn]eftc.sg?.?c[ilv]s...lcdgv[dn]dcgdnsde[ast].c.?.?.?.?.tclpsqfqcgsgycisqrwvcdge.dcedssdeancagsvptc...ef.c..g.c[ilv].....cdg.[dn]dc.d.sde...c..?.?....?.?.?.?.? |

| Fam4 (SEQ ID NOS: 833-839) |
|---|
| CLANQFKCDNGRFIPQTWVCDGDNDCLDGSDEPVHCAKRTCPSSQFQCSSGWCISQRWVCDGENDCEDSSDEANCAGSVPTCPSDEFRCRNGRCIPRAWRCDGVNDCADNSDEEDC--TEHT |
| CLANQFKCDNGRCIPQTWVCDGDNDCLDGSDEPVHCAKRTCPSSQFQCSSGWCISQRWVCDGENDCEDSSDEANCAGSVPTCPSDEFRCRNGRCIPRAWRCDGVNDCADNSDEEDC--TEHT |
| CLANQFKCDNGRCIPQTWVCDGDNDCLDGSDEPVHCAERTCPSSQFQCSSGWCISQRWVCDGENDCEDSSDEANCAGSVPTCPSDEFRCRNGRCIPRAWRCDGVNDCADNSDEEDC--TEHT |
| CLANQFKCDNGRCIPQTWVCDGDNDCLDGSDEPVRCAKRTCPSSQFQCSSGWCISQRWVCDGENDCEDSSDEANCAGSVPTCPSDEFRCRNGRCIPRAWRCDGVNDCADNSDEEGC--TPHT |
| CLANQFKCDNGRCIPQTWVCDGDNDCLDGSDEPVHCAKRTCPSSQFQCSSGWCISQRWVCDGENDCEDSSDEANCAGSVPTCPSDEFRCRNGRCIPRAWRCDGVNDCADNSDEADC--KAHT |
| CLANQFKCDNGRCIPQTWVCDGDNDCLDGSDEPVHCAKRTCPSSQFQCGSGWCISQHWVCDGENDCEDSSDEANCAGSVPTCPSDEFRCRNGRCIPRAWRCDGVNDCGDNSDETNC--APPT |
| CLSSEFTCGNGNCIPQTWVCDGDNDCLDGSDEPVHCAKRTCPSSQFQCSSGWCISQRWVCDGENDCEDSSDEANCAGSVPTCPSSQFRRNNGHCLSVTLVCDGDNDCEDDSDETGCEGSGHT |

| score | matches | expected | motif (SEQ ID NOS: 840-842) |
|---|---|---|---|
| 3802 | 9 | $10^{-120}$ | cl[as].[eq]f.c.ng..ipqtwvcdgdndcldgsdepv.ca[ekq]rtcpssqfqc.sgwcisq.wvcdgendced.sdeancagsvptcps.[eq]fr..ng.c[ilv]..[ast]..cdg.ndc.d[dn]sde...c..?.?...t |
| 3911 | 8 | $10^{-140}$ | clanqfkcdngr.ipqtwvcdgdndcldgsdepv.ca[ekq]rtcpssqfqc.sgwcisq.wvcdgendced.sdeancagsvptcpsdefrcrngrciprawrcdgvndc.dnsde...c..?.?...t |
| 3543 | 7 | $10^{-145}$ | clanqfkcdngr.ipqtwvcdgdndcldgsdepv.ca[ekq]rtcpssqfqcssgwcisqrwvcdgendced.sdeancagsvptcpsdefrcrngrciprawrcdpvndcadnsde...c.?.?..ht |

-continued

Fam5 (SEQ ID NOS: 843-851)

```
CLPDQFRCGNG-QCIPLDWVCDGVNDCEDDSDEESCPPRTCLPDQFQCGSGYCLPQRWVCDGENDCEDSSDEANCAGS---VPT

CLPDQFRCGNG-QCIPLDWVCDGVNDCEDDSDEESCPPRTCLPDQFQCGSGYCLPQRWVCDGENDCEDSSDEANCAGS---VPTCQPGQFRCNNGHCLSQPLV
CDGVPDCEDGSDEAS--CSAPASEPPGSL

CLPDQFRCGNG-QCIPLDWVCDGVNDCEDDSDEESCPPRTCLPDQFQCGSGYCLPQRWVCDGENDCEDSSDEANCAGS---VPTCASSQFPCDNGKCLPPPLV
CDGVDDCGDDSDEPSAPCGSPART

CLPDQFRCGNG-QCIPLDWVCDGVNDCVDGSDEAGCPPRTCLPDQFQCGSGYCLPQRWVCDGENDCEDGSDEANCAGS---VPTCRPDEFKCENGHCIPPGLR
CDGVDDCVDNSDETD--CETPGRT

CLPDQFRCGNG-QCIPLDWVCDGVNDCGDNSDEAGCPTRTCLPSQFQCGSGYCISQRWVCDGENDCEDSSDEANCAGS---VPTCLPGQFRCDNGQCIPAHWG
CDGVNDCRDNSDEAD--CPQPT

CLSSEFTCGNG-NCIPRPWVCDGDNDCVDDSDEKGCPEPTCLPSQFQCGSGYCISQRWVCDGENDCEDSSDEANCAGS---VPTCEADQFQCGSGYCLPRHWV
CDGDNDCEDDSDETD--CGRPGPGATSAPAV

CLSSEFTCGNG-NCIPRPWVCDGDNDCVDDSDEKGCPEPTCLPSQFQCGSGYCISQRWVCDGENDCEDSSDEANCAGS---VPTCAPNQFQCGSGYCVPAAWV
CDGENDCEDNSDESSALCQERT

CLPSEFQCRDSKICLSADWLCDGVNDCVDGSDEAGCPPRTCLPDQFQCGSGYCISQRWVCDGENDCEDSSDEANCAGS---VPTCRASQFQCGSGYCIPRPWL
CDGDNDCEDDSDETN--CTPRT

CVSSQFQCGNG-HCVPAQWLCDGVNDCGDNSDEASCPPRTCAPSQFQCGSGYCIPLTWVRDGVDDCEDGSDEEDCSQDPEFHKVCLADQFQCNNGRCVPQSWG
CDGDDDCQDNSDETS-CAPPT
```

| scorematches | expectedmotif (SEQ ID NOS: 852-854) | |
|---|---|---|
| 2389 | 8 | $10^{-82}$ | c[ilv]..[eq]f.c.[dn]..?.c[ilv]...w[ilv]cdg.ndc.d.sde..cp..tc.p.qfqcgsgyc[ilv]...wv.dg.[dn]dced.sde.[dn]c[as]...?.?.?...c...[eq]f.c..g.c[ilv].....cdg..dc.d.sde...?.?c.... |
| 2444 | 7 | $10^{-98}$ | cl..[eq]f.c.[dn]..?.c[ilv]...w[ilv]cdg.ndc.d.sde..cp..tc.p.qfqcgsgyc[ilv].qrwvcdgendced.sdeancags.?.?.?vptc...[eq]f.c..g.c[ilv].....cdg..dc.d.sde...?.?c.... |
| 2196 | 6 | $10^{-103}$ | cl..[eq]f.cgng.?.cip..wvcdg.ndc.d.sde..cp..tclp.qfqcgsgyc[ilv].qrwvcdgendced.sdeancags.?.?.?vptc...[eq]f.c..g.c[ilv].....cdg..dc.d.sde...?.?c.... |

Draft

The following (SEQ ID NOS:286-339) represent sequences comprising trimers that bind IL-6 (each monomer in the trimer binds IL-6) linked to an IgG binding monomer domain. Included are 9 trimers with one of two anti-IgG domains at the N-terminus, separated by one of two linkers (9×2×2=36 tetramers). Also listed are 9 trimers with one of two anti-IgG domains at the C-terminus, although no linker diversity was investigated for these constructs (9×2=18 tetramers).

CLSSEFQCQSSGRCIPLAWVCDGDNDCRDDSDEKSCKPRTCLPDQFRCGNGQCIPLDWVCDGVN

DCPDDSDEEGCPPRTCAPSQFQCGSGYCISQRWVCDGENDCEDGSDEANCAGSVPTCPSDEFRC

RNGRCIPRAWRCDGVNDCADNSDEEDCTEHT

CLSSEFQCQSSGRCIPLAWVCDGDNDCRDDSDEKSCKPRTCLPDQFRCGNGQCIPLDWVCDGVN

DCADNSDETGCPTRTCLPSQFQCGSGYCISQRWVCDGENDCEDGSDEANCAGSVPTCPSDEFRC

RNGRCIPRAWRCDGVNDCADNSDEEDCTEHT

CLSSEFQCQSSGRCIPLAWVCDGDNDCRDDSDEKSCKPRTCRADEFQCGSGRCVPADWLCDGVN

DCADNSDETGCPTRTCLPSQFQCGSGYCISQRWVCDGENDCEDGSDEANCAGSVPTCPSDEFRC

RNGRCIPRAWRCDGVNDCADNSDEEDCTEHT

CLSSEFQCQSSGRCIPLAWVCDGDNDCRDDSDEKSCKPRTCLPDQFRCGNGQCIPLDWVCDGVN

DCEDDSDEESCPPRTCLPDQFQCGSGYCLPQRWVCDGENDCEDGSDEANCAGSVPTCPSDEFRC

RNGRCIPRAWRCDGVNDCADNSDEEDCTQHT

CLSSEFQCQSSGRCIPLAWVCDGDNDCRDDSDEKSCKPRTCQANEFTCSSGNCLSPALLCDGVD

-continued

DCGDNSDETYCASPAPTCLPSQFQCGSGYCISQRWVCDGENDCEDSSDEANCAGSVPTCQPGEF

TCESGRCLPLRWLCDGEDDCVDSSDEASCQPPT

CLSSEFQCQSSGRCIPLAWVCDGDNDCRDDSDEKSCKPRTCLPDQFRCGNGQCIPLDWVCDGVN

DCEDDSDEESCPPRTCLPDQFQCGSGYCLPQRWVCDGENDCEDGSDEANCAGSVPTCPSDEFRC

RNGRCIPPAWRCDGVNDCADNSDEADCAAPT

CLSSEFQCQSSGRCIPLAWVCDGDNDCRDDSDEKSCKPRTCLPDQFRCGNGQCIPLDWVCDGVN

DCEDDSDEESCPPHTCLPDQFQCGSGYCLSQRWVCDGENDCEDGSDEANCAGSVPTCPSDEFRC

RNGRCIPRAWRCDGVNDCADNSDEEDCTEHT

CLSSEFQCQSSGRCIPLAWVCDGDNDCRDDSDEKSCKPRTCESDQFQCDSGHCVPLNWVCDGVN

DCVDGSDEAGCPPRTCLPGQFQCGSGYCISQRWVCDGENDCEDGSDEANCAGSVPTCPSDEFRC

RNGRCIPRAWRCDGVNDCADNSDEEDCTEHT

CLSSEFQCQSSGRCIPLAWVCDGDNDCRDDSDEKSCKPRTCGASQFQCGSGYCISQRWVCDGEN

DCEDSSDEANCAGSVPTCLPSEFQCRDSKICLSADWLCDGVNDCADNSDEEGCPPPTCLPDQFQ

CGSGYCLPQAWVCDGENDCEDGSDETNCPART

CHPTGQFRCRSSGRCVSPTWVCDGDNDCGDNSDEENCKPRTCLPDQFRCGNGQCIPLDWVCDGV

NDCPDDSDEEGCPPRTCAPSQFQCGSGYCISQRWVCDGENDCEDGSDEANCAGSVPTCPSDEFR

CRNGRCIPRAWRCDGVNDCADNSDEEDCTEHT

CHPTGQFRCRSSGRCVSPTWVCDGDNDCGDNSDEENCKPRTCLPDQFRCGNGQCIPLDWVCDGV

NDCADNSDETGCPTRTCLPSQFQCGSGYCISQRWVCDGENDCEDGSDEANCAGSVPTCPSDEFR

CRNGRCIPRAWRCDGVNDCADNSDEEDCTEHT

CHPTGQFRCRSSGRCVSPTWVCDGDNDCGDNSDEENCKPRTCRADEFQCGSGRCVPADWLCDGV

NDCADNSDETGCPTRTCLPSQFQCGSGYCISQRWVCDGENDCEDGSDEANCAGSVPTCPSDEFR

CRNGRCIPRAWRCDGVNDCADNSDEEDCTEHT

CHPTGQFRCRSSGRCVSPTWVCDGDNDCGDNSDEENCKPRTCLPDQFRCGNGQCIPLDWVCDGV

NDCEDDSDEESCPPRTCLPDQFQCGSGYCLPQRWVCDGENDCEDGSDEANCAGSVPTCPSDEFR

CRNGRCIPRAWRCDGVNDCADNSDEEDCTQHT

CHPTGQFRCRSSGRCVSPTWVCDGDNDCGDNSDEENCKPRTCQANEFTCSSGNCLSPALLCDGV

DDCGDNSDETYCASPAPTCLPSQFQCGSGYCISQRWVCDGENDCEDSSDEANCAGSVPTCQPGE

FTCESGRCLPLRWLCDGEDDCVDSSDEASCQPPT

CHPTGQFRCRSSGRCVSPTWVCDGDNDCGDNSDEENCKPRTCLPDQFRCGNGQCIPLDWVCDGV

NDCEDDSDEESCPPRTCLPDQFQCGSGYCLPQRWVCDGENDCEDGSDEANCAGSVPTCPSDEFR

CRNGRCIPRAWRCDGVNDCADNSDEADCAAPT

CHPTGQFRCRSSGRCVSPTWVCDGDNDCGDNSDEENCKPRTCLPDQFRCGNGQCIPLDWVCDGV

NDCEDDSDEESCPPHTCLPDQFQCGSGYCLSQRWVCDGENDCEDGSDEANCAGSVPTCPSDEFR

CRNGRCIPRAWRCDGVNDCADNSDEEDCTEHT

CHPTGQFRCRSSGRCVSPTWVCDGDNDCGDNSDEENCKPRTCESDQFQCDSGHCVPLNWVCDGV

NDCVDGSDEAGCPPRTCLPGQFQCGSGYCISQRWVCDGENDCEDGSDEANCAGSVPTCPSDEFR

CRNGRCIPRAWRCDGVNDCADNSDEEDCTEHT

CHPTGQFRCRSSGRCVSPTWVCDGDNDCGDNSDEENCKPRTCGASQFQCGSGYCISQRWVCDGE

NDCEDSSDEANCAGSVPTCLPSEFQCRDSKICLSADWLCDGVNDCADNSDEEGCPPPTCLPDQF

-continued

QCGSGYCLPQAWVCDGENDCEDGSDETNCPART

CLSSEFQCQSSGRCIPLAWVCDGDNDCRDDSDEKSCSAPASEPPGSLCLPDQFRCGNGQCIPLD
WVCDGVNDCPDDSDEEGCPPRTCAPSQFQCGSGYCISQRWVCDGENDCEDGSDEANCAGSVPTC
PSDEFRCRNGRCIPRAWRCDGVNDCADNSDEEDCTEHT

CLSSEFQCQSSGRCIPLAWVCDGDNDCRDDSDEKSCSAPASEPPGSLCLPDQFRCGNGQCIPLD
WVCDGVNDCADNSDETGCPTRTCLPSQFQCGSGYCISQRWVCDGENDCEDGSDEANCAGSVPTC
PSDEFRCRNGRCIPRAWRCDGVNDCADNSDEEDCTEHT

CLSSEFQCQSSGRCIPLAWVCDGDNDCRDDSDEKSCSAPASEPPGSLCRADEFQCGSGRCVPAD
WLCDGVNDCADNSDETGCPTRTCLPSQFQCGSGYCISQRWVCDGENDCEDGSDEANCAGSVPTC
PSDEFRCRNGRCIPRAWRCDGVNDCADNSDEEDCTEHT

CLSSEFQCQSSGRCIPLAWVCDGDNDCRDDSDEKSCSAPASEPPGSLCLPDQFRCGNGQCIPLD
WVCDGVNDCEDDSDEESCPPRTCLPDQFQCGSGYCLPQRWVCDGENDCEDGSDEANCAGSVPTC
PSDEFRCRNGRCIPRAWRCDGVNDCADNSDEEDCTQHT

CLSSEFQCQSSGRCIPLAWVCDGDNDCRDDSDEKSCSAPASEPPGSLCQANEFTCSSGNCLSPA
LLCDGVDDCGDNSDETYCASPAPTCLPSQFQCGSGYCISQRWVCDGENDCEDSSDEANCAGSVP
TCQPGEFTCESGRCLPLRWLCDGEDDCVDSSDEASCQPPT

CLSSEFQCQSSGRCIPLAWVCDGDNDCRDDSDEKSCSAPASEPPGSLCLPDQFRCGNGQCIPLD
WVCDGVNDCEDDSDEESCPPRTCLPDQFQCGSGYCLPQRWVCDGENDCEDGSDEANCAGSVPTC
PSDEFRCRNGRCIPRAWRCDGVNDCADNSDEADCAAPT

CLSSEFQCQSSGRCIPLAWVCDGDNDCRDDSDEKSCSAPASEPPGSLCLPDQFRCGNGQCIPLD
WVCDGVNDCEDDSDEESCPPHTCLPDQFQCGSGYCLSQRWVCDGENDCEDGSDEANCAGSVPTC
PSDEFRCRNGRCIPRAWRCDGVNDCADNSDEEDCTEHT

CLSSEFQCQSSGRCIPLAWVCDGDNDCRDDSDEKSCSAPASEPPGSILESDQFQCDSGHCVPLN
WVCDGVNDCVDGSDEAGCPPRTCLPGQFQCGSGYCISQRWVCDGENDCEDGSDEANCAGSVPTC
PSDEFRCRNGRCIPRAWRCDGVNDCADNSDEEDCTEHT

CLSSEFQCQSSGRCIPLAWVCDGDNDCRDDSDEKSCSAPASEPPGSLCGASQFQCGSGYCISQR
WVCDGENDCEDSSDEANCAGSVPTCLPSEFQCRDSKICLSADWLCDGVNDCADNSDEEGCPPPT
CLPDQFQCGSGYCLPQAWVCDGENDCEDGSDETNCPART

CHPTGQFRCRSSGRCVSPTWVCDGDNDCGDNSDEENCSAPASEPPGSLCLPDQFRCGNGQCIPL
DWVCDGVNDCPDDSDEEGCPPRTCAPSQFQCGSGYCISQRWVCDGENDCEDGSDEANCAGSVPT
CPSDEFRCRNGRCIPRAWRCDGVNDCADNSDEEDCTEHT

CHPTGQFRCRSSGRCVSPTWVCDGDNDCGDNSDEENCSAPASEPPGSLCLPDQFRCGNGQCIPL
DWVCDGVNDCADNSDETGCPTRTCLPSQFQCGSGYCISQRWVCDGENDCEDGSDEANCAGSVPT
CPSDEFRCRNGRCIPRAWRCDGVNDCADNSDEEDCTEHT

CHPTGQFRCRSSGRCVSPTWVCDGDNDCGDNSDEENCSAPASEPPGSLCRADEFQCGSGRCVPA
DWLCDGVNDCADNSDETGCPTRTCLPSQFQCGSGYCISQRWVCDGENDCEDGSDEANCAGSVPT
CPSDEFRCRNGRCIPRAWRCDGVNDCADNSDEEDCTEHT

CHPTGQFRCRSSGRCVSPTWVCDGDNDCGDNSDEENCSAPASEPPGSLCLPDQFRCGNGQCIPL
DWVCDGVNDCEDDSDEESCPPRTCLPDQFQCGSGYCLPQRWVCDGENDCEDGSDEANCAGSVPT
CPSDEFRCRNGRCIPRAWRCDGVNDCADNSDEEDCTQHT

-continued

```
CHPTGQFRCRSSGRCVSPTWVCDGDNDCGDNSDEENCSAPASEPPGSLCQANEFTCSSGNCLSP

ALLCDGVDDCGDNSDETYCASPAPTCLPSQFQCGSGYCISQRWVCDGENDCEDSSDEANCAGSV

PTCQPGEFTCESGRCLPLRWLCDGEDDCVDSSDEASCQPPT

CHPTGQFRCRSSGRCVSPTWVCDGDNDCGDNSDEENCSAPASEPPGSLCLPDQFRCGNGQCIPL

DWVCDGVNDCEDDSDEESCPPRTCLPDQFQCGSGYCLPQRWVCDGENDCEDGSDEANCAGSVPT

CPSDEFRCRNGRCIPRAWRCDGVNDCADNSDEADCAAPT

CHPTGQFRCRSSGRCVSPTWVCDGDNDCGDNSDEENCSAPASEPPGSLCLPDQFRCGNGQCIPL

DWVCDGVNDCEDDSDEESCPPHTCLPDQFQCGSGYCLSQRWVCDGENDCEDGSDEANCAGSVPT

CPSDEFRCRNGRCIPRAWRCDGVNDCADNSDEEDCTEHT

CHPTGQFRCRSSGRCVSPTWVCDGDNDCGDNSDEENCSAPASEPPGSLCESDQFQCDSGHCVPL

NWVCDGVNDCVDGSDEAGCPPRTCLPGQFQCGSGYCISQRWVCDGENDCEDGSDEANCAGSVPT

CPSDEFRCRNGRCIPRAWRCDGVNDCADNSDEEDCTEHT

CHPTGQFRCRSSGRCVSPTWVCDGDNDCGDNSDEENCSAPASEPPGSLCGASQFQCGSGYCISQ

RWVCDGENDCEDSSDEANCAGSVPTCLPSEFQCRDSKICLSADWLCDGVNDCADNSDEEGCPPP

TCLPDQFQCGSGYCLPQAWVCDGENDCEDGSDETNCPART

CLPDQFRCGNGQCIPLDWVCDGVNDCPDDSDEEGCPPRTCAPSQFQCGSGYCISQRWVCDGEND

CEDGSDEANCAGSVPTCPSDEFRCRNGRCIPRAWRCDGVNDCADNSDEEDCTEHTCLSSEFQCQ

SSGRCIPLAWVCDGDNDCRDDSDEKSCKPRT

CLPDQFRCGNGQCIPLDWVCDGVNDCADNSDETGCPTRTCLPSQFQCGSGYCISQRWVCDGEND

CEDGSDEANCAGSVPTCPSDEFRCRNGRCIPRAWRCDGVNDCADNSDEEDCTEHTCLSSEFQCQ

SSGRCIPLAWVCDGDNDCRDDSDEKSCKPRT

CRADEFQCGSGRCVPADWLCDGVNDCADNSDETGCPTRTCLPSQFQCGSGYCISQRWVCDGEND

CEDGSDEANCAGSVPTCPSDEFRCRNGRCIPPAWRCDGVNDCADNSDEEDCTEHTCLSSEFQCQ

SSGRCIPLAWVCDGDNDCRDDSDEKSCKPRT

CLPDQFRCGNGQCIPLDWVCDGVNDCEDDSDEESCPPRTCLPDQFQCGSGYCLPQRWVCDGEND

CEDGSDEANCAGSVPTCPSDEFRCRNGRCIPRAWRCDGVNDCADNSDEEDCTQHTCLSSEFQCQ

SSGRCIPLAWVCDGDNDCRDDSDEKSCKPRT

CQANEFTCSSGNCLSPALILDGVDDCGDNSDETYCASPAPTCLPSQFQCGSGYCISQRWVCDGE

NDCEDSSDEANCAGSVPTCQPGEFTCESGRCLPLRWLCDGEDDCVDSSDEASCQPPTCLSSEFQ

CQSSGRCIPLAWVCDGDNDCRDDSDEKSCKPRT

CLPDQFRCGNGQCIPLDWVCDGVNDCEDDSDEESCPPRTCLPDQFQCGSGYCLPQRWVCDGEND

CEDGSDEANCAGSVPTCPSDEFRCRNGRCIPRAWRCDGVNDCADNSDEADCAAPTCLSSEFQCQ

SSGRCIPLAWVCDGDNDCRDDSDEKSCKPRT

CLPDQFRCGNGQCIPLDWVCDGVNDCEDDSDEESCPPHTCLPDQFQCGSGYCLSQRWVCDGEND

CEDGSDEANCAGSVPTCPSDEFRCRNGRCIPRAWRCDGVNDCADNSDEEDCTEHTCLSSEFQCQ

SSGRCIPLAWVCDGDNDCRDDSDEKSCKPRT

CESDQFQCDSGHCVPLNWVCDGVNDCVDGSDEAGCPPRTCLPGQFQCGSGYCISQRWVCDGEND

CEDGSDEANCAGSVPTCPSDEFRCRNGRCIPRAWRCDGVNDCADNSDEEDCTEHTCLSSEFQCQ

SSGRCIPLAWVCDGDNDCRDDSDEKSCKPRT

CGASQFQCGSGYCISQRWVCDGENDCEDSSDEANCAGSVPTCLPSEFQCRDSKICLSADWLCDG
```

-continued
```
VNDCADNSDEEGCPPPTCLPDQFQCGSGYCLPQAWVCDGENDCEDGSDETNCPARTCLSSEFQC

QSSGRCIPLAWVCDGDNDCRDDSDEKSCKPRT

CLPDQFRCGNGQCIPLDWVCDGVNDCPDDSDEEGCPPRTCAPSQFQCGSGYCISQRWVCDGEND

CEDGSDEANCAGSVPTCPSDEFRCRNGRCIPRAWRCDGVNDCADNSDEEDCTEHTCHPTGQFRC

RSSGRCVSPTWVCDGDNDCGDNSDEENCSAPASEPPGSL

CLPDQFRCGNGQCIPLDWVCDGVNDCADNSDETGCPTRTCLPSQFQCGSGYCISQRWVCDGEND

CEDGSDEANCAGSVPTCPSDEFRCRNGRCIPRAWRCDGVNDCADNSDEEDCTEHTCHPTGQFRC

RSSGRCVSPTWVCDGDNDCGDNSDEENCSAPASEPPGSL

CRADEFQCGSGRCVPADWLCDGVNDCADNSDETGCPTRTCLPSQFQCGSGYCISQRWVCDGEND

CEDGSDEANCAGSVPTCPSDEFRCRNGRCIPRAWRCDGVNDCADNSDEEDCTEHTCHPTGQFRC

RSSGRCVSPTWVCDGDNDCGDNSDEENCSAPASEPPGSL

CLPDQFRCGNGQCIPLDWVCDGVNDCEDDSDEESCPPRTCLPDQFQCGSGYCLPQRWVCDGEND

CEDGSDEANCAGSVPTCPSDEFRCRNGRCIPRAWRCDGVNDCADNSDEEDCTQHTCHPTGQFRC

RSSGRCVSPTWVCDGDNDCGDNSDEENCSAPASEPPGSL

CQANEFTCSSGNCLSPALLCDGVDDCGDNSDETYCASPAPTCLPSQFQCGSGYCISQRWVCDGE

NDCEDSSDEANCAGSVPTCQPGEFTCESGRCLPLRWLCDGEDDCVDSSDEASCQPPTCHPTGQF

RCRSSGRCVSPTWVCDGDNDCGDNSDEENCSAPASEPPGSL

CLPDQFRCGNGQCIPLDWVCDGVNDCEDDSDEESCPPRTCLPDQFQCGSGYCLPQRWVCDGEND

CEDGSDEANCAGSVPTCPSDEFRCRNGRCIPRAWRCDGVNDCADNSDEADCAAPTCHPTGQFRC

RSSGRCVSPTWVCDGDNDCGDNSDEENCSAPASEPPGSL

CLPDQFRCGNGQCIPLDWVCDGVNDCEDDSDEESCPPHTCLPDQFQCGSGYCLSQRWVCDGEND

CEDGSDEANCAGSVPTCPSDEFRCRNGRCIPRAWRCDGVNDCADNSDEEDCTEHTCHPTGQFRC

RSSGRCVSPTWVCDGDNDCGDNSDEENCSAPASEPPGSL

CESDQFQCDSGHCVPLNWVCDGVNDCVDGSDEAGCPPRTCLPGQFQCGSGYCISQRWVCDGEND

CEDGSDEANCAGSVPTCPSDEFRCRNGRCIPRAWRCDGVNDCADNSDEEDCTEHTCHPTGQFRC

RSSGRCVSPTWVCDGDNDCGDNSDEENCSAPASEPPGSL

CGASQFQCGSGYCISQRWVCDGENDCEDSSDEANCAGSVPTCLPSEFQCRDSKICLSADWLCDG

VNDCADNSDEEGCPPPTCLPDQFQCGSGYCLPQAWVCDGENDCEDGSDETNCPARTCHPTGQFR

CRSSGRCVSPTWVCDGDNDCGDNSDEENCSAPASEPPGSL
```

Example 8

This example describes experiments demonstrating inhibition of IL-6-induced cell proliferation by IL-6-binding trimers.

TF-1, a GM-CSF dependent human erythroleukemia cell line, was purchased from ATCC(CRL-2003). IL-6 is a potent stimulator of TF-1 cell proliferation. The use of TF-1 cells for determining efficacy of IL-6, IL-6R, and/or gp130 inhibitors is well-established in the art.

TF-1 cells were maintained in growth medium (RPMI 1640 supplemented with 50 uM 2-ME, antibiotic-antimycotic), 10% FBS and 5 ng/ml hGM-CSF (Leukine). Prior to assay, TF-1 cells were washed and cultured overnight in growth medium plus 1% FBS and Leukine. TF-1 cells were then washed three times with growth medium plus 1% FBS, without Leukine prior to the assay.

Serial dilutions of anti-IL-6 monoclonal antibodies (Clone 6708-111, R&D Systems, and Clone MQ2-13A5, eBioscience) or an anti-IL-6 trimer further comprising an IgG binding domain at the N-terminus (which in other experiments was shown not to affect Il-6 binding) was prepared in growth medium plus 1% FBS and incubated with a fixed concentration of rhIL-6 (0.2 ng/ml from R&D Systems) for 45 min in a humidified incubator at 37° C. containing 5% $CO_2$.

TF-1 cells ($1\times10^4$/well) were cultured in the presence or absence of the anti-IL-6 inhibitors-hIL-6 mixture in a 96-well flat bottom plate (Becton Dickinson) in a final volume of 200 ul/well for 40 hr in a humidified incubator at 37° C., 5% CO2. Cells were pulse-labeled with 1 uCi/well of [$^3$H]-Thymidine (Amersham Biosciences) during the final 16 hr of culture. Plates were harvested with a semiautomatic cell harvester (Tomtec, Inc.) and [$^3$H]-Thymidine incorporation was measured using a Microbeta-counter (Wallac-Perkin Elmer). Results are expressed as average cpm from triplicate wells.

Control experiments determined 0.2 ng/mL as the EC50 of rhIL-6 for stimulation of TF-1 cell proliferation.

The anti-IL-6 trimer inhibited TF-1 cell proliferation induced by 0.2 ng/mL IL-6 to 50% of maximum at a concentration of 0.8 picomolar.

This assay provides a means to screen monomers or multimers for anti-IL-6 activity in an in vitro bioassay using human cells. By determining IC50 values for tested multimers or monomers, optimal molecules can be identified and ranked on the basis of their biological activity.

Example 9

This example describes experiments demonstrating monomer binding to a IL-6-expressing human cell line.

Monomers were constructed to include an influenza hemagluttinin (HA) epitope tag. This enables the monomer to be used as a primary flow cytometry detection agent, with a fluorescent-tagged anti-HA secondary antibody being used as the secondary detection agent.

293FT human embryonic kidney cells (Invitrogen) were transiently transfected with a CD23-IL-6 fusion in the pDisplay vector (Invitrogen), resulting in cell surface expression of IL-6.

9 trimers were tested for the ability to bind 293FT/CD23-IL-6 cells. Untransfected 293FT cells, as well as Jurkat, HuT78, ArentAR, U266-BL, Raji, RPMI8226, and Daudi cell lines, were used as negative controls.

To determine monomer binding, $2.5 \times 10^5$ cells were stained with 10 uM IL-6 trimer in 100 ul FACS staining buffer (PBS pH 7.4, 5% fetal calf serum, 0.01% sodium azide) on ice for 30 min. Cells were washed once with 4 ml ice-cold FACS staining buffer, then resuspended in 100 ul FACS staining buffer plus 0.2 ug FITC-conjugated anti-HA monoclonal antibody (Santa Cruz Biotechnology) and incubated on ice for 30 min. Cells were washed once with 4 ml ice-cold FACS staining buffer, then resuspended in 200 ul FACS staining buffer and analyzed using a FACSCalibur Flow Cytometer (BD Biosciences). Data were collected and analyzed using CellQuest Pro (BD Biosciences). The geometric mean fluorescence was determined for each cell line plus IL-6 trimer, and normalized against the geometric mean fluorescence for that cell line plus FITC-conjugated anti-HA monoclonal antibody alone.

The anti-IL-6 trimer showed significant binding only to 293FT/CD23-IL-6 cells, with no binding detected for any of the other cell lines tested.

This assay provides a means to screen monomers or multimers for IL-6 binding specificity. Specificity for IL-6 over other cell-surface proteins can be an important factor in the development of a therapeutic, and can be used to screen and select for optimal molecules.

Example 10

This example describes experiments designed to measure the in vitro binding affinity of anti-IL-6 monomers.

Experiments were performed on a Biacore 1000 SPR machine. The running buffer for all experiments was HBS-P (Biacore) with the addition of 1 mM $CaCl_2$.

~200 RUs of human IL-6 were conjugated to a flowcell of a CM5 chip using NHS/EDC coupling and ethanolamine blocking according to the manufacturer's protocols.

Serial dilutions of the Il-6 binding trimer used in Example 9 were prepared in the running buffer, and injected over the IL-6-conjugated flowcell. Signal resulting from flowing over a mock coupled flowcell was subtracted from the data to minimize bulk shift effects. Data were analyzed using the BiaEvaluation software (Biacore), using a 1:1 Langmuir binding model.

Independent fits of the data to a 1:1 binding model yielded values of $k_{on}=1.95\times10^6$ s$^{-1}$, $k_{off}=4.93\times10^{-4}$ M$^{-1}$ s$^{-1}$, $K_D=2.53\times10^{-10}$ M.

This assay provides a means to screen monomers or multimers for IL-6 binding affinity. Affinity to IL-6 may be used as an indicator of potential biological activity, and can be used to screen and select for optimal molecules.

Example 11

This example describes experiments designed to show in vivo activity of anti-IL-6 trimers in mice.

8 week old female CD-1 mice were used for all experiments.

Optimal IL-6 dose (600 ng/mouse in 100 ul PBS, 1% mouse serum, intraperitoneal injection) and time to sacrifice following IL-6 injection (6 hours) were predetermined by dose titration and measurement of serum amyloid A (SAA) in serum harvested from sacrificed mice by intracardiac puncture.

SAA was measured by ELISA in accordance with the manufacturer's instructions (Biosource). All experiments included three mice per treatment group, with duplicate SAA measurements being made for each mouse.

Trimer doses were prepared in 20 mM Tris, pH7.6, 260 mM NaCl, 1 mM $CaCl_2$, with each dose having a volume of 200 ul per mouse. All monomer preparations contained less than 4 EU/mg endotoxin as measured by the LAL endpoint method (Associates of Cape Cod).

Trimer doses, control monoclonal antibodies (anti-IL-6 or mouse IgG1, 500 ug per mouse in 200 ul) or vehicle alone were injected via the tail vein. One hour later, 600 ng IL-6, 200 ng IL-1, or vehicle alone (PBS, 1% mouse serum) was injected intraperitoneally. Six hours after this second injection the mice were sacrificed, and serum harvested. Serum was frozen for shipment and storage prior to analysis.

The anti-IL-6 trimer completely abrogated acute phase protein induction by human IL-6. In contrast, the anti-IL-6 trimer showed no affect on acute phase protein induction by human IL-1, indicating that the inhibitory effect is specific. The inhibitory effect of anti-IL-6 trimer was also found to be dose-dependent. These results indicate that anti-IL-6 trimer can inhibit specifically the biological functions of IL-6 in an in vivo setting.

Example 12

This example describes generation of additional IL-6 binding sequences based on the A domain scaffold.

The following sequences were identified as binding IL-6 as measured by ELISA binding to IL-6 and also by biological activity in the TF1 cell assay (SEQ ID NOS:855-929):

CESDQFQCDSGHCVPLNWVCDGVNDCVDGSDEAGCPPRTCLPGQFQCGSGYCISQRWVCDGENDCEDGSDEANCAGSVPTCPSDEFRCR
NGRCIPRAWRCDGVNDCADNSDEEDCTEHT

CLPDQFRCGNGQCMPLDWVCDGVYDCPDDSDEEGCPPRTCAQSKFQCGSGYCISQRWVCDGEYDCEDGSDEANCADSVPTCPSDEFRCRNG
RCIPRGWRCDGVNDCADSSDEEDCTENP

CLSVQFRCGNGQCIPLDWVCDGVKDCPDDSDEEGCPPWTCAPSQFQCGSGYCISQRWVCDGESDCEDGSDEANCAGSVPTCPSDEFRCRNG
RCIPRGWLCDGVNDCADNSDEEDCTDNT

CLPDQFRCGNGQCIPLDWVCDGVNDCPDDSDEEGCPPRTCAPSQFQCGSGWCISTRWVCDGENDCEDGSDEANCPGTVPTCPSDEFRCKNG
RCVPRSWCCDGVNDCADNSDEEDCTDPT

CLPDQFRCGNGQCIPLDWVCDGVSDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCIPLDWVCDGVNDCADNSDETGCPTRTCLPSQFQCGSGYCISQRWVCDGENDCEDGSDEANCAGSVPTCPSGEFRCRNG
RCIPRAWRCDGVNDCADNSDEEDCTEHT

CLPDQFRCGNGQCIPLDWVCDGVNDCADNSDETGCPTRTCLPSQFQCGSGYCISQRWVCDGENDCEDGSDEANCAGSVPTCPSDEFRCRNG
CCIPRAWRCDGVNDCTDNSDEGDCTEHT

CLSDQFRCGNGDCIRLDWVCDGVNDCTDDSDEEGCPQRSCAPSQFQCGSGYCISQGWVCDGENDCEDGSDEANCAGCVPTCRSDEFRCRNG
RCIPLAWRCDGVNDCVDNSDEEDCPEHT

CLPDQFRCGNGQCIPLDWVCDGVNDCADXSDEXXCPTRTCXPSQFQCGXXYCISQRWVCDGEXDCEDGSDEANCAGSVPTCPSDEFRCRNG
RCIPRAWRCDGVNDCADNSDEEDCTEHT

CPSDKFRCGNGQCIPLDNVCDGVNDCPDDSDEEGCPPRTCAPSQFQCGSGYCISQRWVCDGENDCEDGSDEANCAGSVPTCPSDEFRCRNG
QCIPLDWVCDGVNDCPDDSDEEDCTEHT

CPSDEFRCGNGQCIPLDWVCDGVNDCPDDSDEEGCPPRTCAPSQFQCGSGYCISQRWVCDGENDCEDGSDEANCAGSVPTCPSDEFRCRNG
RCIPRAWRCDGVNDCADNSDEEDCTEHT

CPSDEFRCGNGQCIPLDWVCDGVNDCPDDSDEXGCPPRTCAPSQFQCGSGYCISQRWVCDGXNDCEDGSDEANCAGSVPTCPSDEFRCXNG
RCIPRAWRCDGVNDCADNSDEXXCTEHT

CPPDQFRCGNGQCIPLDWVCDGVMDCPDDSDEEGCPPRTCAPSQFQCGSGYCISQRWVCDGENDCEDGSDEANCAGSVPTCPWNEFRCRNG
RCIPWSWRCDGVNDCADNSDEEECTEHT

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCIPLDWVCDGVNDCADNSDETSCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCTPLDWVCDGVNDCPDDSDEEGCPPRTCAPSQFQCGSGYCIPQRWVCDGENDCEDGSDEANCAGSVPTCPSGEFQCSNG
RCIPWAWRCDGVNDCADNSDEEDCTEPP

CLPDQFRCGNGQCIPLDWVCDGVNDCPDDSDEEGCPPRTCPPSQFQCGSGYCITERWVCDGENDCEDGSDEANCAGSVPTCSSDEFRCRAG
TCIPRAWCCDGVKDCADNSDEEDCTENT

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDEFQCGNGQCISLDWVCDGVNDCPDDSDEXGCPPSSCPPNQFQCGSGYCISQRWVCDGXNDCEDGSXEANCAGSVPACPSDEFRCRDG
RCIPRAWLCDGINDCADNSDEEDCTEHT

CLAHQFLCGNGQCLPLDWVCDGVTDCPDDSDEVGCPPRTCAPSHFQCGSGYCISQSWVCDGEYDCEDGSDEASCAGSVPSCPSDEFQCRNG
RCIPRPWRCDGVNDCADNSDEEDCTEHT

-continued

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CQANEFTCSSGNCLSPALLCDGVDDCGDNSDEAYCASPAPTCLPSQFQCGSGYCISQRWVCDGENDCEDSSDEANCAGSVPTCQPGEFTCE
SGRCLPLRWLCDGEDDCVDSSDEASCQPPT

CQANEFTCSSGNCLSPALLCDGVDDCGDNSDEAYCASPAPTCLPSQFQCGSGYCISQRWVCDGENDCEDSSDEANCAGSVPTCQPGEFTCE
SGRCLPLRWLCDGEDDCVDSSDEASCQPPT

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRGWRCDGVNDCADTSDEEDCKEHC

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCIPLDNVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGKCIPLDWVCDGVNDCPDASDEEGCPPRTCGPSQFQCGSGYCISQGWVCDGEIDCEDSSDEANCAGSVPTCPSDQFQCSNG
RCIPRAWHCDGINDCEDNSDEEDCTEHT

CLPGQFRCANGQCIPLEWVCDGDNDCPDDSDEDGCPPRTCGPSQFKCGSGYCISESWVCDGEYDCEDGSDEATCVGSVPTCPWDEFRCRSG
RCISRAWRCDGVNDCADNSDEEACTDHT

CLSDQFRCGEGQCIPLDWVCDGVSDCGDDSDEEGCPPSTCAPSQFQCGSGYCISQNWVCDGENDCEDGSDEANCAGCVPTCPADEFRCRDG
RCIPRAWRCDGVNDCGDKSDEEDCTENT

CRPDQFRCGNGHCIPLDWVCDGVNDCTDDSDEGGCPQRSCAPRQPQCGSGYCISQRWVCDGEYDCEDGSDEANCTGSVAACPYDEFRCING
RCIPRSWCCDGVNDCADNSDEADCPEHT

CLPDEFRCGNGHCIPLDWVCDGVNDCPDDSDEEGCPPQTCAPSQFQCGSGFCISQRWVCDGEQDCVDGSDESNCADSVPTCPSDEFRCKNG
RCIPLVWRCDGVNDCSDNSDEEDCKVHS

CRRDQFRCGNGQCISVDWVCDGVNDCPDESDEEGCPPRTCTPSQFMCGSXYCISQRWVCDGEYDCEDGSDXXNCAGSVPTCPKDXFQCRNG
RCIPRAWGCDXX

XXXXXFPGXXRXXXXXXXXXXXXYDCLDXSDEXXCPARTCXXSQFQCGSGYCISQRWVCDGEYDCEDGSDXXNXXXXXXTCXSXEFRCXXG

RCIPRSWRCDGVNDCADNSDEXDCTGHS

CLPGQFRCGNGQCIPLDWVCDGVNDCPDDSDEEGCPPRTCAPNQFQCGSGYCISQRWVCDGENDCEDGSDEANCVGSVTTCPSDEFRCRNG
RCIPRVWRCDGEDDCADNSDEEDCTECT

CLXYXFLCVNGQCIXWXCXXXXXLXXXXXXKXLXXXYLCXXXXXXRXRLLHXXXLGLXXXKXLXXXLGXNKLCWPXTXXSXXXVXVQXXXL

XPXCXAXRXXXXLXGXLXXXXXXRTHFXAXXXXXPXXXXPXXXPL

CXPDQFRCXXGQCIPLDWVCDGVNDCPDNSDEKXCPPRTCXPSQFQCXSGYCISQXWVCDGENDCEDGSDEANCAGSVPXCPSDEFXCRNG

LCIPRAWRCDGVNDCXDNSDEEXCTEHT

CLPNQFRCRNGQCIPLDWVCDGINDCPDESDEEGCPPRTCAPSQFQCGSGYCISRRWVCDGEIDCDDGSDEANCAGSVPACPSDEFRCSNC

RCIPRAWRCDGVNDCSDNSDEEDCTGHT

CLPAQFRCGNGQCIPLDWVCDGVNDCADNSDETGCPTRTCLPSQFQCGSGYCISQRWVCDGENDCXDGSDXXNCAGSVXTCPSDXFRCXNG

RCIPRAWRCXGXNXCGGQL

XXSDQFLCXXGXCIPLXWVCDGIHDXXXXXEXXRXXXXXXXXXXXXXRXRXXLXXXXXXQRQXXXXXRXXXXKXXSFXTXXPXXXFXXQXX

XLXXXXXXXXRXXXXCEQLEXKQXXSAXXFAKGXXGPQAPPPPPPPX

-continued

CLQDQFRCGDGQCIPLEWVCDGVDDCADHSDEEGCPPRTCSPSQFQCGSGYCISQRWVCDGENDCEDGSDEANCPGSVPTCPSDEFRCRNG
RCIPRAWRCDGVSDCADNSDEEDCTEET

CLPDQFRCGNGECIPLDWVCDGVKDCPDDSDEEGCPPPTCAPGQFQCGSGYCISKRWVCDGENDCEDGSDEANCEGSVPACPSDEFRCGNG
RCIPRDWRCDGVHDCEDNSDEEXCTEHN

CLPDQFRCSNGHCIPLDWVCDGVNDCPDDSDEGGCPPRTCAPSQFQCGSGFCISQRWVCDGEHDCEDGSDEANCAVSIPTCPPDDFRCRNG
RCIPRAWCCDGVNDCADNSDEEGCREHT

CPPKQFRCGNGQCIPLDWICDGVNDCTDDSDEEGCPPRSCAPGQFQCGSGYCISQRWVCDGENDCEDGSDEANCPCSVPTCPSDEFRCRNG
PCIPRAWRCDGVNDCADNSDEDDCTGHT

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRHWCCDGVSDCPDNSDEEDCKDHT

CESDQFQCDSGHCVPLNWVCDGVNDCVDGSDEAGCPPRTCLPGQFQCGSGYCISQRWVCDGENDCEDGSDEANCAGSVPTCPSDEFRCRNG
RCIPRAWRCDGVNDCADNSDEEDCTEHT

CLPYQFRCRNGRCIPLDWLCDGVNDCPDDSDEEGCPALTCAPSQFQCGSGYCISQRWVCDGEIDCEDGSDEANCAGSEPTCPSDEFRCXNG
RCIPRAWCCDGVNDCVDNSDEEDCAPHT

CRPDQFRCDNGHCIQLDWVCDGVNDCQDDSDEDGCPPRTCAQSQFQCGSGYCISQSWVCDGENDCEDGSDEANCAGSVPTCPSDEFRCRNG
RCIPRAWRCDGINDCEDHSDEEDCKAHT

CLPDQFRCGNGQCIPLDWVCDGVNDCPDDSDEEGCPPRTCAPSQFQCGSGYCISQRWVCDGENDCEDGSDEANCAGSVPTCPSEEFRCRNG
XCXXRAWXCDGVNDCXDNSDEEXCTEHP

CLPDQFRCGNGQCIPLDWVCDGVNDCADNSDETGCPTRTCLSSQFQCGSGYCISQRWVCDGENDCEDGSDEANCAGSVPTCPSDEPRCRNG
RCIPRAWRCDGVNDCADNSDEEDCTEHT

CLPDQFRCGNGQCIPLDWACDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCIPLDWVCDGVNDCADNSDETGCPTRTCLPSQFQCGSGYCISQRWVCDGENDCEDGSDEANCAGSVPTCPSDEFRCRNG
RCIPRAWRCDGVNDCADNSDEEDCTEHT

CLPDQFRCGNGQCIPLDWVCDGVNDCPDDSDEEGCPPRTCAPSQFQCGSGYCISQRWVCDGENDCEDGSDEANCAGSVPTCPSDEFRCRNG
RCIPRAWRCDGVNDCADNSDEEDCTEHT

CLPDQFRCGNGRCIPLDWVCDGVNDCQDDSDEEGCPPRTCAPSQFQCGSGYCISQGWVCDGENDCEDGSDEANCAGPVPTCAADEFRCRNG
RCIPRAWRCDGVNDCADNSDEEACTEHT

CPRTSSAAATANAIHGPGFATAILICPDDSDEDGCPPRTCSPNQFQCGSGYCISQRWVCDGEIDCEDGSDEANCAGSVPKCPSDAFRCRNG
RCIPRAWRCDGINDCVDNSDEEECREHT

CPRTSSAAATANAIHGPGFATAILICPDDSDEDGCPPRTCSPNQFQCGSGYCISQRWVCDGEIDCEDGSDEANCAGSVPKCPSDAFRCRNG
RCIPRAWRCDGINDCVDNSDEEECREHT

CLPDQFRCGNGQCIPLDWVCDGVNDCADNSDETGCPTRTCLPSQFQCGSGYCISQRWVCDGENDCEDGSDEANCAGSVPTCPSDEFRCRNG

RCIPRAWRCDGVNDCADNSDEEDCTEHT

CPPEQFRCGTGKCIPMDWVCDGVKDCPDDSDEEGCPPRTCAPHQFQCGSGFCISQRWVCDGENDCEDGSDEANCAGSVPTCPSNEFRCRNG

RCIPCSWHCDGVNDCADNSDEEDCTPHP

CVPDQFRCGNGQCIPLDWVCDGVNDCADNSDETGCPTRTCLPSQFQCGSGYCISQRWVCDGENDCEDGSDEAHCAGSVPTCPADEFRCRNG

GCIPLAWRCDGVNDCADNSDEEDCTDDT

CLPDQFRCGNGQCIPLDWVCDGVNDCADNSDETGCPTRTCLPSQFQCGSGYCISQRWVCDGENDCEDGSDEANCAGSVPTCPSDEFRCRNG

RCIPRAWRCDGVNDCADNSDEEDCTEHT

-continued
```
CLPDQFRCGNGQCIPLDWVCDGVNDCADNSDETGCPTRTCLPSQFQCGSGYCISQRWVCDGENDCEDGSDEANCAGSVPTCPSDEFRCRNG

RCITRAWRCDGVNDCADNSDEEDCTEHT

CLPGQFRCGNGQCIPLDWVCDGVNDCPDDSDEEGCPPRTCAPNQFQCGSGYCISQRWVCDGENDCEDGSDEANCVGSVTTCPSDEFRCRNG

RCIPRVWRCDGEDDCADNSDEEDCTECT

CPSPVPVRQRPLRSTGLGLRRRQCLSDDSDEEGCPARTCGPGQFQCGSGYCISQRWVCDGENDCEDGSDEANCAGSVPTCTSDEFRCRNGR

CIPRAWRCDGVKDCADNSDEEPCKEHQ

CLPDQFRCDNGQCIPLDWVCDGVNDCPDDSDEQGCPPRSCAPSQFQCGSGYCISQRWVCDGEYDCEDGSDEANCAGSAPTCPSEEFRCRNG

RCIPNAWCCDGLNDCSDNSDEEDCAEHP

CLPDQFRCGNGQCIPLDWICDGLIDCPDESDEEGCPPRTCEPSQFQCGSGFCISQGWVCDGEIDCEDGSDEANCAGSVPTCPSDEFRCRSG

RCIPRAWRCDGISDCADGSDEEDCTEDT

CAPSQFQCGSGYCISQRWVCDGENDCEDGSDEVGCPPRTCAPSQFQCGSGWCISQRWVCDGENDCEDGSDEANCAGSVPTCPSDEFRCRSG

RCIPRAWRCDGVSDCADGSDEEDCTEDT

CLRDQFRCGNGQCIPLDWACDGINDCPDDSDEGGCPPRMCAPSQFQCGSGYCIPLGWVCDGENDCEDGSDEANCAGSEPTCPSGEFRCRNG

RCIPRAWLCDGVNDCADNSDEEDCTGHT

CLPDMFRCGTRQCIPLDWVCDGVNDCADNSDETGCPTRTCLPSQFQCGSGYCISQRWVCDGENDCEDGSDEANCAGSVPTCPSDEFRCRNG

RCIPRSWCCDGVNDCADNSDEEDCTEHT

CLPDQFRCGNGQCIPLDWVCDGVNDCADNSDETGCPTRTCLPSQFQCGSGYCISQRWVCDGENDCEDGSDEANCADSVPTCPSYEFRCRNG

RCIPRTWRCDGVNDCADNSDEEDCTEHP

CLANQFKCDNGRCIPQTWVCDGDNDCLDGSDEPVHCAKRTCPSSQFQCSSGWCISQRWVCDGENDCEDNSDEANCAGSVPTCGPGQFPCND

SDRCLSVPRLCDGDDDCGDDSDEASCQPPT

CLPDQFRCGNGQCMPLDWVCDGVNDCPDDSDEEGCPPRTCEPGQFQCGSGYCISQRWVCDGENDCEDGSDEATCAGSVPQCPSDEFRCRTG

RCIPQAWRCDGVNDCVDNSDEECCKEHT

CLANQFKCDNGRCIPQTWVCDGDNDCLDGSDEPVHCAKRTCPSSQFQCSSGWCISQRWVCDGENDCEDSSDEANCAGSVPT

CVSDQFRCGNGQCLPLDWVCDGVNDCPDDSDEEGCPPLTCAPSQFQCGSGYCISQRWVCDGEYDCEDGSDEANCAGSVPTCPSDEFRCRNG

RCIPRAWCCDGINDCTDNSDEEDCTEYT

CPRTSSAAATANAIHGPGFATAILICPDDSDEDGCPPRTCSPNQFQCGSGYCISQRWVCDGEIDCEDGSDEANCAGSVPKCPSDAFRCRNG

RCIPRAWRCDGINDCVDNSDEEECREHT

CLPDRFRCGNGQCMPMDWVCDGVNDCPDDSDERGCPPRTCAQSQFQCGSGYCISESWVCDGENDCEDGSDEANCAGSVPTCPSDEFRCSNG

RCIPRSWLCDGVNDCSDNSDEEDCAEHP
```

Example 13

This example describes experiments designed to measure the inhibitory activity of an exemplary IL-6/IgG binding tetramer.

Human heparinized-whole blood was obtained from six normal individuals from Stanford University Blood Bank. The avimer used in these experiments was generated as described in the above examples.

Briefly, 500 ul of heparinized human blood from several donors was cultured in 12×75 mm tubes or individual wells of a 24 well plate in the presence of 50 ng/ml of human IL-6; exemplary IL-6/IgG binding tetramers, a negative control avimer, 0.01-600 nM; anti-IL-6 monoclonal antibody (Clone 6708-111, R&D Systems) or mouse IgG1 isotype control antibody (eBioscience), 3, 10 or 30 ug/ml, or no inhibitors. Inhibitors or controls were diluted in RPMI1640+10% human AB serum before addition to the cultures. Final volume was 1 ml per sample.

Figure 11:
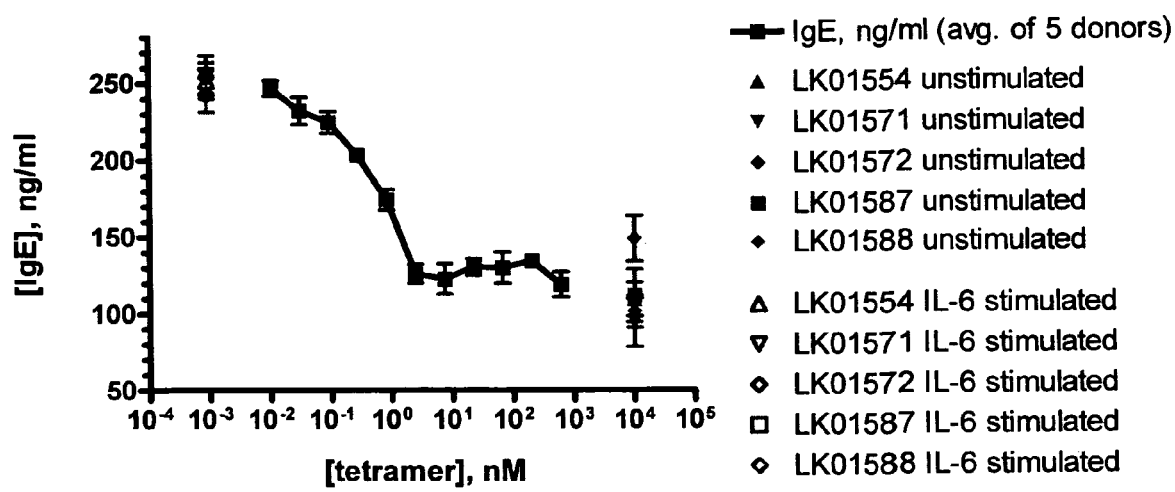
FIG. 11 shows that an exemplary IL-6/IgG binding tetramer inhibits the production of IL-6 induced IgE expression in whole blood, as described in Example 13.

Samples were incubated for 6.5 hr at 37° C. with 5% $CO_2$. Samples were removed from incubator and centrifuged at 1500 rpm for 10 minutes at room temperature. Plasma samples were divided in two portions and one set was shipped to Rules Based Medicine for determination of the concentrations of IL-6- and avimer-regulated analytes. The second set of plasma samples was stored at −80° C. Results from these experiments are shown in FIG. 11.

Stimulation with IL-6 increased the concentration of IgE in the supernatants 2-3 fold (FIG. 11; other data not shown) compared to unstimulated controls or controls treated with anti-IL-6 mAb. Treatment with an anti-IL-6 avimer decreased the concentration of IgE in a dose-dependent fashion compared to treatment with a control avimer. Treatment with the anti-IL-6 avimer resulted in an $IC_{50}$ value of about 0.5 nM.

Example 14

This example describes experiments demonstrating an anti-IL-6 tetramer's ability to inhibit human IgG production ex vivo.

Human blood buffy coats form normal donors were obtained from Stanford University blood bank. Human B cells were purified from PBMC by positive selection by using CD19 Microbeads (Myltenyi Biotec) according to the manufacturer's protocol.

CD19+ B cells were cultured in 200 ul/well in a 96-well flat bottom culture plate with sCD40L (1 ng/ml) (R&D Systems) in the presence or absence of hrIL-6 (1 ng/ml) (Prepotech), 15 ng/ml of hIL-4 (R&D Systems), 60 ng/ml of hIL-2 (R&D Systems), 3 ng/ml of IL-10 (R&D Systems) in the presence of exemplary IL-6/IgG binding tetramers. Cultures were carried out in RPMI 1640 supplemented with 10% FBS, antibiotic-antimycotic, L-Glutamine at 37° C. in a humidified atmosphere in 5% CO2. All cytokines were added at the beginning of the culture (Day 0). Cell culture supernatants were collected at day 8 or day 10 and levels of hIgG determined by an ELISA method (Bethyl Laboratories #E80-104).

In some cases irradiated (10,000 rad) D1.1 (20,000 cells/well), a Jurkat cell line expressing CD40L was used instead of sCD40L.

Figure 12:
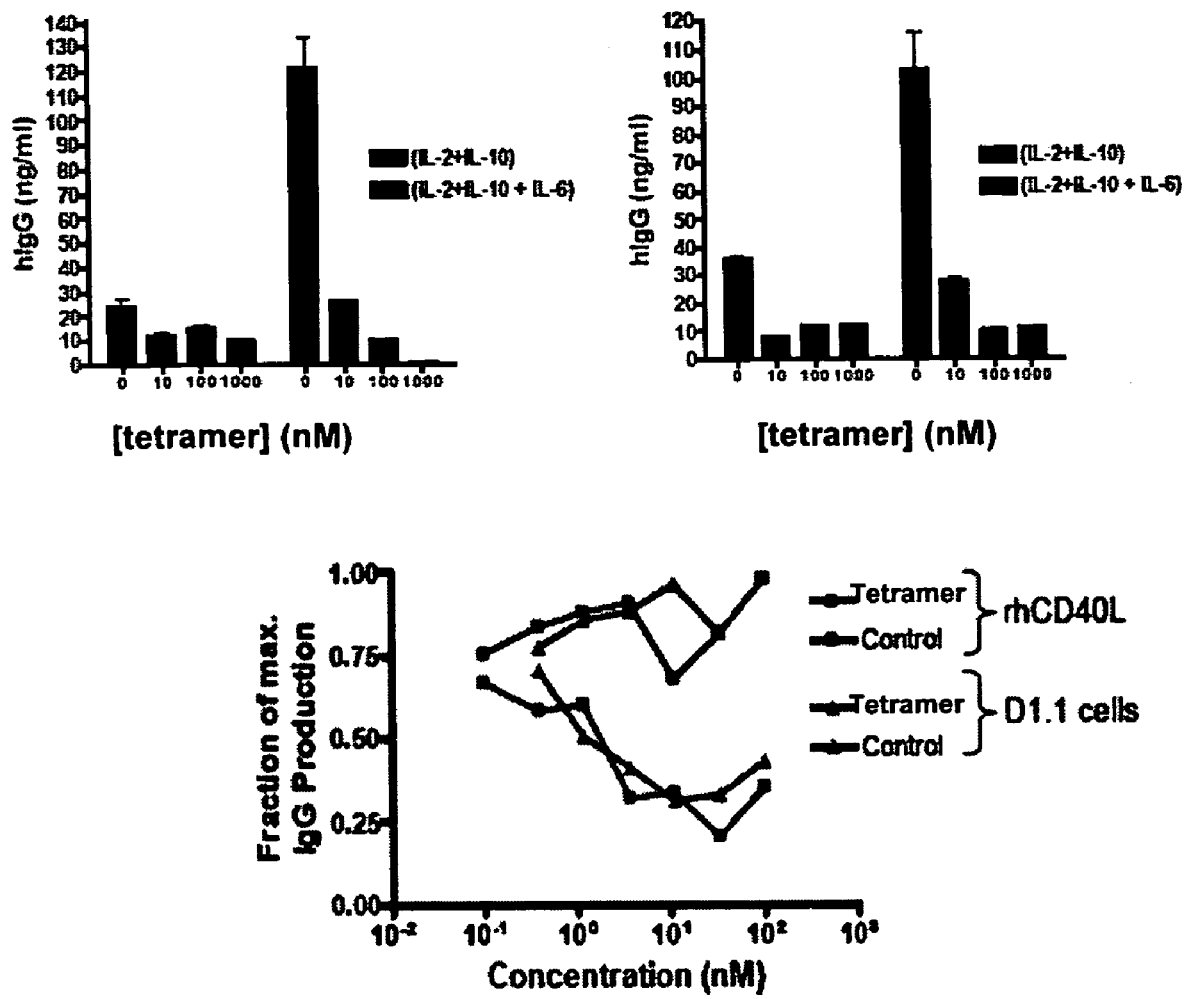
FIG. 12 shows that an exemplary IL-6/IgG binding tetramer inhibits the production of IgG from activated primary B cells, as described in Example 14.

Results from these experiments are shown in FIG. 12. Treatment with increasing concentrations of an exemplary IL-6/IgG binding tetramer inhibited IgG production, as seen by the decreased concentrations of IgG (top panels). The exemplary IL-6/IgG binding tetramer inhibited IL-6-induced IgG production in this system regardless of whether CD40L was provided as a recombinant soluble protein or presented on the cell surface of an accessory cell, as seen by the decreased fraction of maximum IgG production (lower panel). Thus, IL-6/IgG binding tetramers inhibit IgG production by activated primary B cells.

Example 15

Human hepatoblastoma cell lines HepG2 (#HB8065) and HepG2/C3a (#CRL10741) were purchased from ATCC. Hepatoma cells were cultured in DMEM containing 10% FBS in 24 well plates ($0.5 \times 10^6$ cells/well) for two days to allow the cells to attach to the wells. Medium was changed at day 3 and fresh medium containing DMEM-1% FBS supplemented with antibiotic-antimycotic was added to each well. Cultures were stimulated with hIL-1β (10 ng/ml; R&D Systems), hIL-6 (10 ng/ml; R&D Systems) and TNFα (10 ng/ml; R&D Systems) in the presence or absence of exemplary IL-6/IgG binding tetramers, anti-IL-6 mAb (R&D Systems), or isotype control mAb. Cell culture supernatants were collected at 24 h, 48 h and 72 h and analyzed for serum amyloid A ("SAA") by using an ELISA from Biosource.

Figure 13:
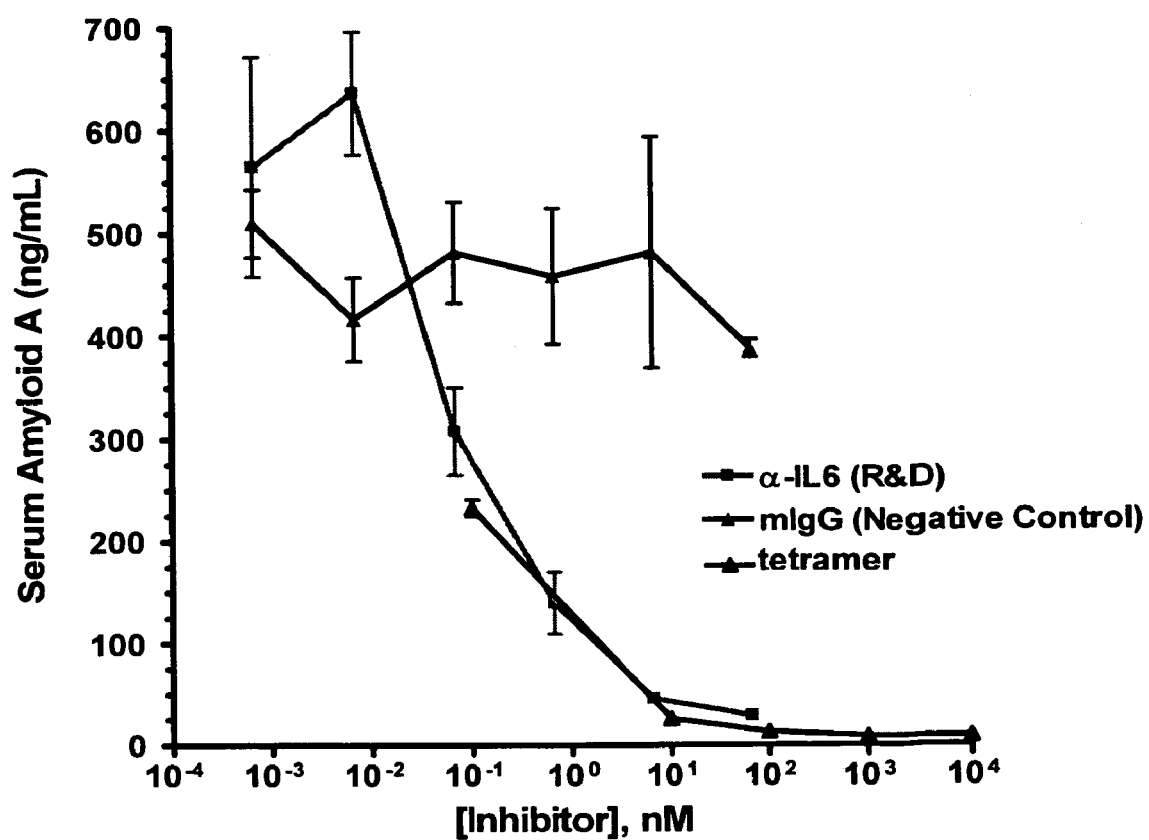
FIG. 13 shows that an exemplary IL-6/IgG binding tetramer inhibits the production of serum amyloid A (SAA) from hepatocytes, as described in Example 15.

Results from these experiments are shown in FIG. 13. Treatment with increasing concentrations of either anti-IL-6 antibodies or an exemplary IL-6/IgG binding tetramer resulted in a dose-dependent decrease in the concentration of SAA compared to treatment with the isotype control antibody. Thus, exemplary IL-6/IgG binding tetramers inhibit IL-6-dependent acute phase protein production by a human hepatoma cell line.

While the foregoing invention has been described in some detail for purposes of clarity and understanding, it will be clear to one skilled in the art from a reading of this disclosure that various changes in form and detail can be made without departing from the true scope of the invention. For example, all the techniques, methods, compositions, apparatus and systems described above can be used in various combinations. All publications, patents, patent applications, or other documents cited in this application are incorporated by reference in their entirety for all purposes to the same extent as if each individual publication, patent, patent application, or other document were individually indicated to be incorporated by reference for all purposes. PCT applications PCT/US02/13257 and PCT/US03/35664 and U.S. Patent Publication No. 2005/0089932 are hereby incorporated by reference in their entirety.

SEQUENCE LISTING

SEQ ID NO: 1—IL-6 Processed Amino Acid Sequence

APVPPGEDSKDVAAPHRQPLTSSERIDKQIRYILDGISALRKETCNKSNM

CESSKEALAENNLNLPKMAEKDGCFQSGFNEETCLVKIITGLLEFEVYLE

YLQNRFESSEEQARAVQMSTKVLIQFLQKKAKNLDAITTPDPTTNASLLT

KLQAQNQWLQDMTTHLILRSFKEFLQSSLRALRQM

SEQUENCE LISTING (949 sequences)

SEQ ID NO: 1 - protein, 185 aa, Homo sapiens
APVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 2 - protein, 35 aa, Artificial Sequence
  Description of Artificial Sequence: Synthetic polypeptide
  MOD_RES (2)..(4): Variable amino acid
  MOD_RES (9)..(9): Variable amino acid
  MOD_RES (12)..(12): Trp or Tyr
  MOD_RES (14)..(14): Ile, Leu or Phe
  MOD_RES (15)..(17): Variable amino acid
  MOD_RES (19)..(19): Val or Leu
  MOD_RES (23)..(23): Variable amino acid
  MOD_RES (29)..(29): Variable amino acid
  MOD_RES (33)..(34): Variable amino acid
CXXXQFQCXSGXCXXXXWXCDGXNDCEDXSDEXXC

SEQ ID NO: 3 - protein, 35 aa, Artificial Sequence
  Description of Artificial Sequence: Synthetic polypeptide
  MOD_RES (2)..(2): Variable amino acid
  MOD_RES (3)..(3): Ala or Pro
  MOD_RES (4)..(4): Variable amino acid
  MOD_RES (5)..(5): Glu or Gln
  MOD_RES (7)..(7): Variable amino acid
  MOD_RES (9)..(10): Variable amino acid
  MOD_RES (14)..(14): Ile or Leu
  MOD_RES (16)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
CXXXXFXCXXGQCXPXXXXCDGXXDCXDXSDEXXC

SEQ ID NO: 4 - protein, 170 aa, Artificial Sequence
  Description of Artificial Sequence: Synthetic polypeptide
  MOD_RES (2)..(2): Variable amino acid
  MOD_RES (3)..(3): Ala or Pro
  MOD_RES (4)..(4): Variable amino acid
  MOD_RES (5)..(5): Glu or Gln
  MOD_RES (7)..(7): Variable amino acid
  MOD_RES (9)..(10): Variable amino acid
  MOD_RES (14)..(14): Ile or Leu
  MOD_RES (16)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(135): Variable amino acid and this region may encompass 0 to 100 residues
  MOD_RES (137)..(139): Variable amino acid
  MOD_RES (144)..(144): Variable amino acid
  MOD_RES (147)..(147): Trp or Tyr
  MOD_RES (149)..(149): Ile, Leu or Phe
  MOD_RES (150)..(152): Variable amino acid
  MOD_RES (154)..(154): Val or Leu
  MOD_RES (158)..(158): Variable amino acid
  MOD_RES (164)..(164): Variable amino acid
  MOD_RES (168)..(169): Variable amino acid
CXXXXFXCXXGQCXPXXXXCDGXXDCXDXSDEXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCXXXQFQCXSGXCXXXXWXCDGXNDCEDXSDEXXC

SEQ ID NO: 5 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHT

SEQ ID NO: 6 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 7 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 8 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHT

SEQ ID NO: 9 - protein, 169 aa, Artificial Sequence
  Description of Artificial Sequence: Synthetic polypeptide
CHPTGQFRCRSSGRCVSPTWVCDGDNDCGDNSDEENCSAPASEPPGSLCQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPT

SEQ ID NO: 10 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPT

SEQ ID NO: 11 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHT

SEQ ID NO: 12 - protein, 167 aa, Artificial Sequence
  Description of Artificial Sequence: Synthetic polypeptide
CHPTGQFRCRSSGRCVSPTWVCDGDNDCGDNSDEENCSAPASEPPGSLCESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHT

SEQ ID NO: 13 - protein, 168 aa, Artificial Sequence
  Description of Artificial Sequence: Synthetic polypeptide
CHPTGQFRCRSSGRCVSPTWVCDGDNDCGDNSDEENCSAPASEPPGSLCGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPART

SEQ ID NO: 14 - protein, 119 aa, Artificial Sequence
  Description of Artificial Sequence: Synthetic polypeptide
CLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHT

SEQ ID NO: 15 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 16 - protein, 119 aa, Artificial Sequence
  Description of Artificial Sequence: Synthetic polypeptide
CRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 17 - protein, 119 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHT

SEQ ID NO: 18 - protein, 121 aa, Artificial Sequence
  Description of Artificial Sequence: Synthetic polypeptide
CQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPT

SEQ ID NO: 19 - protein, 119 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPT

SEQ ID NO: 20 - protein, 119 aa, Artificial Sequence
  Description of Artificial Sequence: Synthetic polypeptide
CLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHT

SEQ ID NO: 21 - protein, 119 aa, Artificial Sequence
  Description of Artificial Sequence: Synthetic polypeptide
CESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHT

SEQ ID NO: 22 - protein, 120 aa, Artificial Sequence
  Description of Artificial Sequence: Synthetic polypeptide
CGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPART

SEQ ID NO: 23 - protein, 26 aa, Artificial Sequence
  Description of Artificial Sequence: Synthetic polypeptide
  MOD_RES (2)..(2): Variable amino acid
  MOD_RES (10)..(11): Variable amino acid
  MOD_RES (17)..(18): Variable amino acid
  MOD_RES (23)..(23): Variable amino acid
CXSSGRCIPXXWVCDGXXDCRDXSDE

SEQ ID NO: 24 - protein, 26 aa, Artificial Sequence
  Description of Artificial Sequence: Synthetic polypeptide
  MOD_RES (2)..(2): Variable amino acid
  MOD_RES (10)..(11): Variable amino acid
  MOD_RES (17)..(18): Variable amino acid
  MOD_RES (23)..(23): Variable amino acid
CXSSGRCIPXXWLCDGXXDCRDXSDE

SEQ ID NO: 25 - protein, 29 aa, Artificial Sequence
  Description of Artificial Sequence: Synthetic polypeptide
  MOD_RES (1)..(1): Glu or Gln
  MOD_RES (3)..(3): Variable amino acid
  MOD_RES (6)..(6): Variable amino acid
  MOD_RES (7)..(7): Ser or Thr
  MOD_RES (8)..(8): Variable amino acid
  MOD_RES (11)..(11): Ile or Val
  MOD_RES (12)..(14): Variable amino acid
  MOD_RES (16)..(16): Ile, Leu or Val
  MOD_RES (20)..(21): Variable amino acid
  MOD_RES (24)..(24): Variable amino acid
  MOD_RES (26)..(26): Asp or Asn
XFXCRXXXRCXXXXWXCDGXXDCXDXSDE

SEQ ID NO: 26 - protein, 37 aa, Artificial Sequence
  Description of Artificial Sequence: Synthetic polypeptide
CHPTGQFRCRSSGRCVSPTWVCDGDNDCGDNSDEENC

SEQ ID NO: 27 - protein, 39 aa, Artificial Sequence
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(16): Variable amino acid
  MOD_RES (18)..(19): Variable amino acid
  MOD_RES (24)..(24): Asp or Asn
  MOD_RES (27)..(27): Variable amino acid
  MOD_RES (33)..(34): Variable amino acid
  MOD_RES (36)..(36): Ala, Ser or Thr
  MOD_RES (37)..(38): Variable amino acid
  MOD_RES (39)..(39): Ala, Ser or Thr
CXXXEFXCXXGXCXXXAXXCDGVXDCXDNSDEXXCXXXX

SEQ ID NO: 28 - protein, 39 aa, Artificial Sequence
  Description of Artificial Sequence: Synthetic polypeptide
  MOD_RES (2)..(4): Variable amino acid
  MOD_RES (7)..(7): Variable amino acid
  MOD_RES (9)..(9): Asp or Asn
  MOD_RES (12)..(12): Variable amino acid
  MOD_RES (16)..(17): Variable amino acid
  MOD_RES (19)..(19): Variable amino acid
  MOD_RES (23)..(23): Asp or Glu
  MOD_RES (24)..(24): Asp or Asn
  MOD_RES (27)..(27): Variable amino acid
  MOD_RES (29)..(29): Asp or Asn
  MOD_RES (33)..(34): Variable amino acid
  MOD_RES (36)..(37): Variable amino acid
  MOD_RES (39)..(39): Ala, Ser or Thr
CXXXQFXCXNGXCVPXXWXCDGXXDCXDXSDEXXCXXPX

SEQ ID NO: 29 - protein, 35 aa, Artificial Sequence; identical to SEQ ID NO: 2
  Description of Artificial Sequence: Synthetic polypeptide
  MOD_RES (2)..(4): Variable amino acid
  MOD_RES (9)..(9): Variable amino acid
  MOD_RES (12)..(12): Trp or Tyr
  MOD_RES (14)..(14): Ile, Leu or Phe
  MOD_RES (15)..(17): Variable amino acid
  MOD_RES (19)..(19): Val or Leu
  MOD_RES (23)..(23): Variable amino acid
  MOD_RES (29)..(29): Variable amino acid
  MOD_RES (33)..(34): Variable amino acid

SEQ ID NO: 30 - protein, 37 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (35)..(36): Variable amino acid that may or may not be present
CXXXXFXCXXGXCXXXXXXCDGXXDCXDXSDEXXXXC

SEQ ID NO: 31 - protein, 35 aa, Artificial Sequence; identical to SEQ ID NO: 3
  Description of Artificial Sequence: Synthetic polypeptide
  MOD_RES (2)..(2): Variable amino acid
  MOD_RES (3)..(3): Ala or Pro
  MOD_RES (4)..(4): Variable amino acid
  MOD_RES (5)..(5): Glu or Gln
  MOD_RES (7)..(7): Variable amino acid
  MOD_RES (9)..(10): Variable amino acid
  MOD_RES (14)..(14): Ile or Leu
  MOD_RES (16)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid

SEQ ID NO: 32 - protein, 40 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(9): Variable amino acid
  MOD_RES (10)..(10): Variable amino acid that may or may not be present
  MOD_RES (12)..(13): Variable amino acid
  MOD_RES (15)..(15): Ile, Leu or Val
  MOD_RES (16)..(17): Variable amino acid
  MOD_RES (18)..(18): Asp or Asn
  MOD_RES (20)..(20): Ile, Leu or Val
  MOD_RES (28)..(28): Variable amino acid
  MOD_RES (30)..(30): Variable amino acid
  MOD_RES (34)..(34): Variable amino acid
  MOD_RES (37)..(39): Variable amino acid
CXXXXFXCXXSXXCXXXXWXCDGVNDCXDXSDEXGCXXXT

SEQ ID NO: 33 - protein, 40 aa, Artificial Sequence
  Description of Artificial Sequence: Synthetic polypeptide
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(9): Variable amino acid
  MOD_RES (12)..(12): Variable amino acid
  MOD_RES (16)..(16): Lys, Gln or Arg
  MOD_RES (17)..(17): Variable amino acid
  MOD_RES (27)..(27): Ile, Leu or Val
  MOD_RES (29)..(29): Variable amino acid
  MOD_RES (33)..(33): May or may not be present
  MOD_RES (34)..(35): Variable amino acid
  MOD_RES (37)..(37): Variable amino acid
  MOD_RES (38)..(38): Glu, Lys or Gln
  MOD_RES (39)..(39): Variable amino acid
CLXXXFXCXNGXCIPXXWVCDGDNDCXDXSDEPXXCXXXT

SEQ ID NO: 34 - DNA, 534 bp, Artificial Sequence
  Description of Artificial Sequence: Synthetic polynucleotide
atgaaacactctggtggttcgtgtcaccctaccggccaatttagatgccgcagtagcggcagatgcgtttcaccgacctgggtttgcgacggcgataatgattgtggggacaactcggatgaagaaaactgtagcgcgccagcatctgaaccgccgggttccctgtgtctgccggaccagttccggtgcggcaacggccaatgcattccactggactgggtttgcgacggcgttaatgattgtccggacgactcggatgaagaaggctgtccaccgcgtacgtgtgcgccgagccagttccagtgcggcagcggctactgcatttcacagcgctgggtttgcgacggcgaaaatgattgtgaggacggctcggatgaagcaaactgtgcaggctccgtacctacgtgtccgtcggacgagttccggtgcagaaacggccgctgcattccacgggcctggcgttgcgacggcgtaaatgattgtgcggacaactcggatgaagaagactgtacagagcatacgtcattgcagtag

SEQ ID NO: 35 - protein, 177 aa, Artificial Sequence
  Description of Artificial Sequence: Synthetic polypeptide
MKHSGGSCHPTGQFRCRSSGRCVSPTWVCDGDNDCGDNSDEENCSAPASEPPGSLCLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHTSLQ

SEQ ID NO: 36 - DNA, 534 bp, Artificial Sequence
  Description of Artificial Sequence: Synthetic polynucleotide
atgaaacactctggtggtagctgtcaccctaccggccaatttcgttgccgcagtagcggccgttgcgtttcaccgacctgggtttgcgacggcgataatgattgtggcgacaacagcgatgaagaaaactgtagcgcgccagcatctgaaccgccgggttccctgtgtctgccggaccagttccgttgcggcaacggccaatgcattccactggactgggtttgcgacggcgttaatgattgtccggacgactcggatgaagaaggctgtccaccgcgtacgtgtgcgccgagccagttccagtgcggcagcggctactgcattagccagcgctgggtttgcgacggcgaaaatgattgtgaggacggctcggatgaagcaaactgtgcaggctccgtacctacgtgtccgtcggacgagttccgctgccgtaacggccgctgcattccacgtgcctggcgctgcgacggcgtaaatgattgtgcggacaacagcgatgaagaagactgtaccgagcatacgtcattgcagtaa

SEQ ID NO: 37 - protein, 35 aa, Artificial Sequence
  Description of Artificial Sequence: Synthetic polypeptide
  MOD_RES (2)..(7): Variable amino acid
  MOD_RES (9)..(12): Variable amino acid
  MOD_RES (14)..(19): Variable amino acid
  MOD_RES (21)..(25): Variable amino acid
  MOD_RES (27)..(34): Variable amino acid
CXXXXXXCXXXXCXXXXXXCXXXXXCXXXXXXXXC

SEQ ID NO: 38 - protein, 35 aa, Homo sapiens
CEPYQFRCKNNRCVPGRWQCDYDNDCGDNSDEESC

SEQ ID NO: 39 - protein, 36 aa, Homo sapiens
CLPSQFKCTNTNRCIPGIFRCNGQDNCGDGEDERDC

SEQ ID NO: 40 - protein, 35 aa, Homo sapiens
CSQDEFRCHDGKCISRQFVCDSDRDCLDGSDEASC

SEQ ID NO: 41 - protein, 35 aa, Homo sapiens
CSSSAFTCGHGECIPAHWRCDKRNDCVDGSDEHNC

SEQ ID NO: 42 - protein, 36 aa, Homo sapiens
CSSSEFQCASGRCIPQHWYCDQETDCFDASDEPASC

SEQ ID NO: 43 - protein, 36 aa, Homo sapiens
CHSQGLVECRNGQCIPSTFQCDGDEDCKDGSDEENC

SEQ ID NO: 44 - protein, 35 aa, Homo sapiens
CPAQTFRCSNGKCLSKSQQCNGKDDCGDGSDEASC

SEQ ID NO: 45 - protein, 34 aa, Homo sapiens
CEGFVCAQTGRCVNRRLLCNGDNDCGDQSDEANC

SEQ ID NO: 46 - protein, 36 aa, Homo sapiens
CTKHTYRCLNGLCLSKGNPECDGKEDCSDGSDEKDC

SEQ ID NO: 47 - protein, 38 aa, Homo sapiens
CLGPGKFKCRSGECIDISKVCNQEQDCRDWSDEPLKEC

SEQ ID NO: 48 - protein, 37 aa, Homo sapiens
CPAEKLSCGPTSHKCVPASWRCDGEKDCEGGADEAGC

SEQ ID NO: 49 - protein, 41 aa, Homo sapiens
CTHFMDFVCKNRQQCLFHSMVCDGIIQCRDGSDEDAAFAGC

SEQ ID NO: 50 - protein, 40 aa, Homo sapiens
CAYNQFQCLSRFTKVYTCLPESLKCDGNIDCLDLGDEIDC

SEQ ID NO: 51 - protein, 35 aa, Artificial Sequence
  Description of Artificial Sequence: Synthetic polypeptide
  MOD_RES (2)..(5): Variable amino acid
  MOD_RES (7)..(7): Variable amino acid
  MOD_RES (9)..(10): Variable amino acid
  MOD_RES (12)..(12): Variable amino acid
  MOD_RES (15)..(19): Variable amino acid
  MOD_RES (23)..(24): Variable amino acid
  MOD_RES (27)..(27): Variable amino acid
  MOD_RES (29)..(29): Variable amino acid
  MOD_RES (33)..(34): Variable amino acid
CXXXXFXCXXGXCIXXXXXCDGXXDCXDXSDEXXC

SEQ ID NO: 52 - protein, 35 aa, Artificial Sequence; identical to SEQ ID NO: 37
  Description of Artificial Sequence: Synthetic polypeptide
  MOD_RES (2)..(5): Variable amino acid
  MOD_RES (6)..(6): Hydrophobic amino acid
  MOD_RES (7)..(7): Variable amino acid
  MOD_RES (9)..(12): Variable amino acid
  MOD_RES (14)..(14): Hydrophobic amino acid
  MOD_RES (15)..(17): Variable amino acid
  MOD_RES (18)..(18): Hydrophobic amino acid
  MOD_RES (19)..(19): Variable amino acid
  MOD_RES (21)..(21): Negatively charged amino acid
  MOD_RES (22)..(24): Variable amino acid
  MOD_RES (25)..(25): Negatively charged amino acid
  MOD_RES (27)..(30): Variable amino acid
  MOD_RES (31)..(32): Negatively charged amino acid
  MOD_RES (33)..(34): Variable amino acid

SEQ ID NO: 53 - protein, 37 aa, Homo sapiens
CNPGQFACRSGTIQCIPLPWQCDGWATCEDESDEANC

SEQ ID NO: 54 - protein, 35 aa, Homo sapiens
CQADEFRCDNGKCLPGPWQCNTVDECGDGSDEGNC

SEQ ID NO: 55 - protein, 38 aa, Homo sapiens
CPGGTFPCSGARSTRCLPVERRCDGLQDCGDGSDEAGC

SEQ ID NO: 56 - protein, 46 aa, Homo sapiens
CLPWEQPCGSSSDSDGGSLGDQGCFSEPQRCDGWWHCASGRDEQGC

SEQ ID NO: 57 - protein, 37 aa, Homo sapiens
CPPDQYPCEGGSGLCYTPADRCNNQKSCPDGADEKNC

SEQ ID NO: 58 - protein, 35 aa, Homo sapiens
CQPGTFHCGTNLCIFETWRCDGQEDCQDGSDEHGC

SEQ ID NO: 59 - protein, 37 aa, Homo sapiens
CSPDQFACATGEIDCIPGAWRCDGFPECDDQSDEEGC

SEQ ID NO: 60 - protein, 35 aa, Homo sapiens
CSAAQFPCARGQCVDLRLRCDGEADCQDRSDEVDC

SEQ ID NO: 61 - protein, 35 aa, Homo sapiens
CLPNQFRCASGQCVLIKQQCDSFPDCIDGSDELMC

SEQ ID NO: 62 - protein, 37 aa, Homo sapiens
CSPQQFTCFTGEIDCIPVAWRCDGFTECEDHSDELNC

SEQ ID NO: 63 - protein, 35 aa, Homo sapiens
CSESQFQCASGQCIDGALRCNGDANCQDKSDEKNC

SEQ ID NO: 64 - protein, 35 aa, Homo sapiens
CLIDQFRCANGQCIGKHKKCDHNVDCSDKSDELDC

SEQ ID NO: 65 - protein, 35 aa, Homo sapiens
CACDQFRCGNGKCIPEAWKCNNMDECGDSSDEEIC

SEQ ID NO: 66 - protein, 40 aa, Homo sapiens; identical to SEQ ID NO: 50

SEQ ID NO: 67 - protein, 36 aa, Homo sapiens
CLPWEIPCGGNWGCYTEQQRCDGYWHCPNGRDETNC

SEQ ID NO: 68 - protein, 36 aa, Homo sapiens
CQKEEFPCSRNGVCYPRSDRCNYQNHCPNGSDEKNC

SEQ ID NO: 69 - protein, 35 aa, Homo sapiens
CQPGNFHCKNNRCVFESWVCDSQDDCGDGSDEENC

SEQ ID NO: 70 - protein, 36 aa, Homo sapiens
CGRGENFLCASGICIPGKLQCNGYNDCDDWSDEAHC

SEQ ID NO: 71 - protein, 35 aa, Homo sapiens
CSENLFHCHTGKCLNYSLVCDGYDDCGDLSDEQNC

SEQ ID NO: 72 - protein, 36 aa, Homo sapiens
CNPTTEHRCGDGRCIAMEWVCDGDHDCVDKSDEVNC

SEQ ID NO: 73 - protein, 36 aa, Homo sapiens; identical to SEQ ID NO: 43

SEQ ID NO: 74 - protein, 35 aa, Homo sapiens
CSPSHFKCRSGQCVLASRRCDGQADCDDDSDEENC

SEQ ID NO: 75 - protein, 37 aa, Homo sapiens
CKERDLWECPSNKQCLKHTVICDGFPDCPDYMDEKNC

SEQ ID NO: 76 - protein, 35 aa, Homo sapiens
CQDDELECANHACVSRDLWCDGEADCSDSSDEWDC

SEQ ID NO: 77 - protein, 36 aa, Homo sapiens
CSNSGIECDSSGTCINPSNWCDGVSHCPGGEDENRC

SEQ ID NO: 78 - protein, 35 aa, Homo sapiens
CSGKYRCRSSFKCIELIARCDGVSDCKDGEDEYRC

SEQ ID NO: 79 - protein, 34 aa, Homo sapiens
CPGQFTCRTGRCIRKELRCDGWADCTDHSDELNC

SEQ ID NO: 80 - protein, 36 aa, Homo sapiens
CDAGHQFTCKNKFCKPLFWVCDSVNDCGDNSDEQGC

SEQ ID NO: 81 - protein, 35 aa, Homo sapiens; identical to SEQ ID NO: 44

SEQ ID NO: 82 - protein, 36 aa, Homo sapiens; identical to SEQ ID NO: 46

SEQ ID NO: 83 - protein, 38 aa, Homo sapiens
CLPGSSPCTDALTCIKADLFCDGEVNCPDGSDEDNKMC

SEQ ID NO: 84 - protein, 35 aa, Homo sapiens
CKADHFQCKNGECVPLVNLCDGHLHCEDGSDEADC

SEQ ID NO: 85 - protein, 35 aa, Homo sapiens
CQPTQFRCSNGCCIDSFLECDDTPNCPDASDEAAC

SEQ ID NO: 86 - protein, 42 aa, Homo sapiens
CYTQKADSPMDDFFQCVNGKYISQMKACDGINDCGDQSDELC

SEQ ID NO: 87 - protein, 35 aa, Homo sapiens
CQGKGFHCKSGVCIPSQYQCNGEVDCITGEDEVGC

SEQ ID NO: 88 - protein, 34 aa, Homo sapiens
CKNKFRCDSGRCIARKLECNGENDCGDNSDERDC

SEQ ID NO: 89 - protein, 35 aa, Homo sapiens
CGERFRCFSGQCISKSLVCNGDSDCDEDSADEDRC

SEQ ID NO: 90 - protein, 35 aa, Homo sapiens
CGQDFQCKETGRCLKRHLVCNGDQDCLDGSDEDDC

SEQ ID NO: 91 - protein, 34 aa, Homo sapiens; identical to SEQ ID NO: 45

SEQ ID NO: 92 - protein, 34 aa, Homo sapiens
CGNDFQCSTGRCIKMRLRCNGDNDCGDFSDEDDC

SEQ ID NO: 93 - protein, 36 aa, Homo sapiens
CTEAEFACHSYNECVALEYRCDRRPDCRDMSDELNC

SEQ ID NO: 94 - protein, 35 aa, Homo sapiens
CGPQEAACRNGHCIPRDYLCDGQEDCEDGSDELDC

SEQ ID NO: 95 - protein, 35 aa, Homo sapiens
CEPNEFPCGNGHCALKLWRCDGDFDCEDRTDEANC

SEQ ID NO: 96 - protein, 36 aa, Homo sapiens
CGPTQFRCVSTNMCIPASFHCDEESDCPDRSDEFGC

SEQ ID NO: 97 - protein, 35 aa, Homo sapiens
CLRNQYRCSNGNCINSIWWCDFDNDCGDMSDERNC

SEQ ID NO: 98 - protein, 37 aa, Homo sapiens
CDLDTQFRCQESGTCIPLSYKCDLEDDCGDNSDESHC

SEQ ID NO: 99 - protein, 35 aa, Homo sapiens
CRSDEYNCSSGMCIRSSWVCDGDNDCRDWSDEANC

SEQ ID NO: 100 - protein, 37 aa, Homo sapiens
CEASNFQCRNGHCIPQRWACDGDTDCQDGSDEDPVNC

SEQ ID NO: 101 - protein, 33 aa, Homo sapiens
CNGFRCPNGTCIPSSKHCDGLRDCSDGSDEQHC

SEQ ID NO: 102 - protein, 41 aa, Homo sapiens; identical to SEQ ID NO: 49

SEQ ID NO: 103 - protein, 35 aa, Homo sapiens
CDEFGFQCQNGVCISLIWKCDGMDDCGDYSDEANC

SEQ ID NO: 104 - protein, 36 aa, Homo sapiens
CSRYFQFRCENGHCIPNRWKCDRENDCGDWSDEKDC

SEQ ID NO: 105 - protein, 35 aa, Homo sapiens
CLPNYYRCSSGTCVMDTWVCDGYRDCADGSDEEAC

SEQ ID NO: 106 - protein, 36 aa, Homo sapiens
CDRFEFECHQPKTCIPNWKRCDGHQDCQDGRDEANC

SEQ ID NO: 107 - protein, 36 aa, Homo sapiens
CMSREFQCEDGEACIVLSERCDGFLDCSDESDEKAC

SEQ ID NO: 108 - protein, 35 aa, Homo sapiens
CEKDQFQCRNERCIPSVWRCDEDDDCLDHSDEDDC

SEQ ID NO: 109 - protein, 37 aa, Homo sapiens
CADSDFTCDNGHCIHERWKCDGEEECPDGSDESEATC

SEQ ID NO: 110 - protein, 37 aa, Homo sapiens; identical to SEQ ID NO: 48

SEQ ID NO: 111 - protein, 35 aa, Homo sapiens
CAPHEFQCGNRSCLAAVFVCDGDDDCGDGSDERGC

SEQ ID NO: 112 - protein, 40 aa, Homo sapiens
CGPREFRCGGDGGGACIPERWVCDRQFDCEDRSDEAAELC

SEQ ID NO: 113 - protein, 36 aa, Homo sapiens
CATVSQFACRSGECVHLGWRCDGDRDCKDKSDEADC

SEQ ID NO: 114 - protein, 35 aa, Homo sapiens
CRGDEFQCGDGTCVLAIKHCNQEQDCPDGSDEAGC

SEQ ID NO: 115 - protein, 37 aa, Homo sapiens
CERNEFQCQDGKCISYKWVCDGSAECQDGSDESQETC

SEQ ID NO: 116 - protein, 37 aa, Homo sapiens
CKSGDFSCGGRVNRCIPQFWRCDGQVDCDNGSDEQGC

SEQ ID NO: 117 - protein, 35 aa, Homo sapiens; identical to SEQ ID NO: 40

SEQ ID NO: 118 - protein, 37 aa, Homo sapiens
CGPASFQCNSSTCIPQLWACDNDPDCEDGSDEWPQRC

SEQ ID NO: 119 - protein, 35 aa, Homo sapiens
CSAFEFHCLSGECIHSSWRCDGGPDCKDKSDEENC

SEQ ID NO: 120 - protein, 35 aa, Homo sapiens
CRPDEFQCSDGNCIHGSRQCDREYDCKDMSDEVGC

SEQ ID NO: 121 - protein, 38 aa, Homo sapiens
CEGPNKFKCHSGECITLDKVCNMARDCRDWSDEPIKEC

SEQ ID NO: 122 - protein, 35 aa, Homo sapiens
CEPSQFQCTNGRCITLLWKCDGDEDCVDGSDEKNC

SEQ ID NO: 123 - protein, 37 aa, Homo sapiens
CAESDFVCNNGQCVPSRWKCDGDPDCEDGSDESPEQC

SEQ ID NO: 124 - protein, 37 aa, Homo sapiens
CRIHEISCGAHSTQCIPVSWRCDGENDCDSGEDEENC

SEQ ID NO: 125 - protein, 35 aa, Homo sapiens
CSPDEFTCSSGRCISRNFVCNGQDDCSDGSDELDC

SEQ ID NO: 126 - protein, 37 aa, Homo sapiens
CGAHEFQCSTSSCIPISWVCDDDADCSDQSDESLEQC

SEQ ID NO: 127 - protein, 35 aa, Homo sapiens
CPASEIQCGSGECIHKKWRCDGDPDCKDGSDEVNC

SEQ ID NO: 128 - protein, 35 aa, Homo sapiens
CRPDQFECEDGSCIHGSRQCNGIRDCVDGSDEVNC

SEQ ID NO: 129 - protein, 38 aa, Homo sapiens; identical to SEQ ID NO: 47

SEQ ID NO: 130 - protein, 38 aa, Homo sapiens
CSPKQFACRDQITCISKGWRCDGERDCPDGSDEAPEIC

SEQ ID NO: 131 - protein, 37 aa, Homo sapiens
CQPNEHNCLGTELCVPMSRLCNGVQDCMDGSDEGPHC

SEQ ID NO: 132 - protein, 37 aa, Homo sapiens
CQPGEFACANSRCIQERWKCDGDNDCLDNSDEAPALC

SEQ ID NO: 133 - protein, 37 aa, Homo sapiens
CPSDRFKCENNRCIPNRWLCDGDNDCGNSEDESNATC

SEQ ID NO: 134 - protein, 36 aa, Homo sapiens
CPPNQFSCASGRCIPISWTCDLDDDCGDRSDESASC

SEQ ID NO: 135 - protein, 36 aa, Homo sapiens
CFPLTQFTCNNGRCININWRCDNDNDCGDNSDEAGC

SEQ ID NO: 136 - protein, 37 aa, Homo sapiens
CSSTQFKCNSGRCIPEHWTCDGDNDCGDYSDETHANC

SEQ ID NO: 137 - protein, 36 aa, Homo sapiens
CHTDEFQCRLDGLCIPLRWRCDGDTDCMDSSDEKSC

SEQ ID NO: 138 - protein, 37 aa, Homo sapiens
CDPSVKFGCKDSARCISKAWVCDGDNDCEDNSDEENC

SEQ ID NO: 139 - protein, 38 aa, Homo sapiens
CRPPSHPCANNTSVCLPPDKLCDGNDDCGDGSDEGELC

SEQ ID NO: 140 - protein, 38 aa, Homo sapiens
CRAQDEFECANGECINFSLTCDGVPHCKDKSDEKPSYC

SEQ ID NO: 141 - protein, 35 aa, Homo sapiens
CKKTFRQCSNGRCVSNMLWCNGADDCGDGSDEIPC

SEQ ID NO: 142 - protein, 35 aa, Homo sapiens
CGVGEFRCRDGTCIGNSSRCNQFVDCEDASDEMNC

SEQ ID NO: 143 - protein, 45 aa, Homo sapiens
CSSYFRLGVKGVLFQPCERTSLCYAPSWVCDGANDCGDYSDERDC

SEQ ID NO: 144 - protein, 35 aa, Homo sapiens
CPLNYFACPSGRCIPMSWTCDKEDDCEHGEDETHC

SEQ ID NO: 145 - protein, 36 aa, Homo sapiens
CSEAQFECQNHRCISKQWLCDGSDDCGDGSDEAAHC

SEQ ID NO: 146 - protein, 39 aa, Homo sapiens
CGPSSFSCPGTHVCVPERWLCDGDKDCADGADESIAAGC

SEQ ID NO: 147 - protein, 36 aa, Homo sapiens
CDDREFMCQNRQCIPKHFVCDHDRDCADGSDESPEC

SEQ ID NO: 148 - protein, 40 aa, Homo sapiens
CGPSEFRCANGRCLSSRQWECDGENDCHDQSDEAPKNPHC

SEQ ID NO: 149 - protein, 36 aa, Homo sapiens
CNASSQFLCSSGRCVAEALLCNGQDDCGDSSDERGC

SEQ ID NO: 150 - protein, 36 aa, Homo sapiens
CTASQFVCKNDKCIPFWWKCDTEDDCGDHSDEPPDC

SEQ ID NO: 151 - protein, 35 aa, Homo sapiens
CRPGQFQCSTGICTNPAFICDGDNDCQDNSDEANC

SEQ ID NO: 152 - protein, 36 aa, Homo sapiens; identical to SEQ ID NO: 39

SEQ ID NO: 153 - protein, 37 aa, Homo sapiens
CAPNQFQCSITKRCIPRVWVCDRDNDCVDGSDEPANC

SEQ ID NO: 154 - protein, 38 aa, Homo sapiens
CGVDEFRCKDSGRCIPARWKCDGEDDCGDGSDEPKEEC

SEQ ID NO: 155 - protein, 35 aa, Homo sapiens; identical to SEQ ID NO: 38

SEQ ID NO: 156 - protein, 35 aa, Homo sapiens
CSESEFSCANGRCIAGRWKCDGDHDCADGSDEKDC

SEQ ID NO: 157 - protein, 35 aa, Homo sapiens
CDMDQFQCKSGHCIPLRWRCDADADCMDGSDEEAC

SEQ ID NO: 158 - protein, 37 aa, Homo sapiens
CPLDEFQCNNTLCKPLAWKCDGEDDCGDNSDENPEEC

SEQ ID NO: 159 - protein, 37 aa, Homo sapiens
CPPNRPFRCKNDRVCLWIGRQCDGTDNCGDGTDEEDC

SEQ ID NO: 160 - protein, 36 aa, Homo sapiens
CKDKKEFLCRNQRCLSSSLRCNMFDDCGDGSDEEDC

SEQ ID NO: 161 - protein, 35 aa, Homo sapiens
CDSAHFRCGSGHCIPADWRCDGTKDCSDDADEIGC

SEQ ID NO: 162 - protein, 37 aa, Homo sapiens
CQQGYFKCQSEGQCIPSSWVCDQDQDCDDGSDERQDC

SEQ ID NO: 163 - protein, 35 aa, Homo sapiens
CSSHQITCSNGQCIPSEYRCDHVRDCPDGADENDC

SEQ ID NO: 164 - protein, 33 aa, Homo sapiens
CEQLTCDNGACYNTSQKCDWKVDCRDSSDEINC

SEQ ID NO: 165 - protein, 35 aa, Homo sapiens
CLHNEFSCGNGECIPRAYVCDHDNDCQDGSDEHAC

SEQ ID NO: 166 - protein, 35 aa, Homo sapiens
CGGYQFTCPSGRCIYQNWVCDGEDDCKDNGDEDGC

SEQ ID NO: 167 - protein, 42 aa, Homo sapiens
CSPREWSCPESGRCISIYKVCDGILDCPGREDENNTSTGKYC

SEQ ID NO: 168 - protein, 35 aa, Homo sapiens
CGLFSFPCKNGRCVPNYYLCDGVDDCHDNSDEQLC

SEQ ID NO: 169 - protein, 35 aa, Homo sapiens; identical to SEQ ID NO: 41

SEQ ID NO: 170 - protein, 35 aa, Homo sapiens
CLDTQYTCDNHQCISKNWVCDTDNDCGDGSDEKNC

SEQ ID NO: 171 - protein, 35 aa, Homo sapiens
CQPSQFNCPNHRCIDLSFVCDGDKDCVDGSDEVGC

SEQ ID NO: 172 - protein, 36 aa, Homo sapiens
CTASQFKCASGDKCIGVTNRCDGVFDCSDNSDEAGC

SEQ ID NO: 173 - protein, 37 aa, Homo sapiens
CHSDEFQCQEDGICIPNFWECDGHPDCLYGSDEHNAC

SEQ ID NO: 174 - protein, 35 aa, Homo sapiens
CPSSYFHCDNGNCIHRAWLCDRDNDCGDMSDEKDC

SEQ ID NO: 175 - protein, 37 aa, Homo sapiens
CPSWQWQCLGHNICVNLSVVCDGIFDCPNGTDESPLC

SEQ ID NO: 176 - protein, 37 aa, Homo sapiens
CGASSFTCSNGRCISEEWKCDNDNDCGDGSDEMESVC

SEQ ID NO: 177 - protein, 35 aa, Homo sapiens
CSPTAFTCANGRCVQYSYRCDYYNDCGDGSDEAGC

SEQ ID NO: 178 - protein, 38 aa, Homo sapiens
CNATTEFMCNNRRCIPREFICNGVDNCHDNNTSDEKNC

SEQ ID NO: 179 - protein, 38 aa, Homo sapiens
CQSGYTKCHNSNICIPRVYLCDGDNDCGDNSDENPTYC

SEQ ID NO: 180 - protein, 36 aa, Homo sapiens; identical to SEQ ID NO: 42

SEQ ID NO: 181 - protein, 38 aa, Homo sapiens
CLADEFKCDGGRCIPSEWICDGDNDCGDMSDEDKRHQC

SEQ ID NO: 182 - protein, 41 aa, Homo sapiens
CSDSEFLCVNDRPPDRRCIPQSWVCDGDVDCTDGYDENQNC

SEQ ID NO: 183 - protein, 35 aa, Homo sapiens
CSENEFTCGYGLCIPKIFRCDRHNDCGDYSDERGC

SEQ ID NO: 184 - protein, 37 aa, Homo sapiens
CQQNQFTCQNGRCISKTFVCDEDNDCGDGSDELMHLC

SEQ ID NO: 185 - protein, 35 aa, Homo sapiens
CPPHEFKCDNGRCIEMMKLCNHLDDCLDNSDEKGC

SEQ ID NO: 186 - protein, 37 aa, Homo sapiens
CSSTQFLCANNEKCIPIWWKCDGQKDCSDGSDELALC

SEQ ID NO: 187 - protein, 37 aa, Homo sapiens
CRLGQFQCSDGNCTSPQTLCNAHQNCPDGSDEDRLLC

SEQ ID NO: 188 - protein, 37 aa, Homo sapiens
CDSNEWQCANKRCIPESWQCDTFNDCEDNSDEDSSHC

SEQ ID NO: 189 - protein, 37 aa, Homo sapiens
CRPGQFRCANGRCIPQAWKCDVDNDCGDHSDEPIEEC

SEQ ID NO: 190 - protein, 37 aa, Homo sapiens
CDNFTEFSCKTNYRCIPKWAVCNGVDDCRDNSDEQGC

SEQ ID NO: 191 - protein, 36 aa, Homo sapiens
CHPVGDFRCKNHHCIPLRWQCDGQNDCGDNSDEENC

SEQ ID NO: 192 - protein, 35 aa, Homo sapiens
CTESEFRCVNQQCIPSRWICDHYNDCGDNSDERDC

SEQ ID NO: 193 - protein, 35 aa, Homo sapiens
CHPEYFQCTSGHCVHSELKCDGSADCLDASDEADC

SEQ ID NO: 194 - protein, 37 aa, Homo sapiens
CQATMFECKNHVCIPPYWKCDGDDDCGDGSDEELHLC

SEQ ID NO: 195 - protein, 38 aa, Homo sapiens
CNSPNRFRCDNNRCIYSHEVCNGVDDCGDGTDETEEHC

SEQ ID NO: 196 - protein, 35 aa, Homo sapiens
CTEYEYKCGNGHCIPHDNVCDDADDCGDWSDELGC

SEQ ID NO: 197 - protein, 38 aa, Homo sapiens
CDPGEFLCHDHVTCVSQSWLCDGDPDCPDDSDESLDTC

SEQ ID NO: 198 - protein, 37 aa, Homo sapiens
CPLNHIACLGTNKCVHLSQLCNGVLDCPDGYDEGVHC

SEQ ID NO: 199 - protein, 37 aa, Homo sapiens
CKAGEFRCKNRHCIQARWKCDGDDDCLDGSDEDSVNC

SEQ ID NO: 200 - protein, 37 aa, Homo sapiens
CPDDQFKCQNNRCIPKRWLCDGANDCGSNEDESNQTC

SEQ ID NO: 201 - protein, 36 aa, Homo sapiens
CQVDQFSCGNGRCIPRAWLCDREDDCGDQTDEMASC

SEQ ID NO: 202 - protein, 36 aa, Homo sapiens
CEPLTQFVCKSGRCISSKWHCDSDDDCGDGSDEVGC

SEQ ID NO: 203 - protein, 37 aa, Homo sapiens
CFDNQFRCSSGRCIPGHWACDGDNDCGDFSDEAQINC

SEQ ID NO: 204 - protein, 36 aa, Homo sapiens
CNGNEFQCHPDGNCVPDLWRCDGEKDCEDGSDEKGC

SEQ ID NO: 205 - protein, 37 aa, Homo sapiens
CDHKTKFSCWSTGRCINKAWVCDGDIDCEDQSDEDDC

SEQ ID NO: 206 - protein, 38 aa, Homo sapiens
CGPPKHPCANDTSVCLQPEKLCNGKKDCPDGSDEGYLC

SEQ ID NO: 207 - protein, 38 aa, Homo sapiens
CNAYSEFECGNGECIDYQLTCDGIPHCKDKSDEKLLYC

SEQ ID NO: 208 - protein, 35 aa, Homo sapiens
CRRGFKPCYNRRCIPHGKLCDGENDCGDNSDELDC

SEQ ID NO: 209 - protein, 35 aa, Homo sapiens
CATVEFRCADGTCIPRSARCNQNIDCADASDEKNC

SEQ ID NO: 210 - protein, 45 aa, Homo sapiens
CTHFYKLGVKTTGFIRCNSTSLCVLPTWICDGSNDCGDYSDELKC

SEQ ID NO: 211 - protein, 35 aa, Homo sapiens
CEENYFSCPSGRCILNTWICDGQKDCEDGRDEFHC

SEQ ID NO: 212 - protein, 37 aa, Homo sapiens
CSWNQFACSAQKCISKHWICDGEDDCGDGLDESDSIC

SEQ ID NO: 213 - protein, 39 aa, Homo sapiens
CAADMFSCQGSRACVPRHWLCDGERDCPDGSDELSTAGC

SEQ ID NO: 214 - protein, 36 aa, Homo sapiens
CDENAFMCHNKVCIPKQFVCDHDDDCGDGSDESPQC

SEQ ID NO: 215 - protein, 40 aa, Homo sapiens
CGTEEFSCADGRCLLNTQWQCDGDFDCPDHSDEAPLNPKC

SEQ ID NO: 216 - protein, 35 aa, Homo sapiens
CNSSFFMCKNGRCIPSGGLCDNKDDCGDGSDERNC

SEQ ID NO: 217 - protein, 36 aa, Homo sapiens
CTASQFRCKTDKCIPFWWKCDTVDDCGDGSDEPDDC

SEQ ID NO: 218 - protein, 35 aa, Homo sapiens
CQPGRFQCGTGLCALPAFICDGENDCGDNSDELNC

SEQ ID NO: 219 - protein, 36 aa, Homo sapiens
CLSGQFKCTKNQKCIPVNLRCNGQDDCGDEEDERDC

SEQ ID NO: 220 - protein, 36 aa, Homo sapiens
CSPDYFQCKTTKHCISKLWVCDEDPDCADASDEANC

SEQ ID NO: 221 - protein, 35 aa, Homo sapiens
CGPHEFQCKNNNCIPDHWRCDSQNDCSDNSDEENC

SEQ ID NO: 222 - protein, 35 aa, Homo sapiens
CTLKDFLCANGDCVSSRFWCDGDFDCADGSDERNC

SEQ ID NO: 223 - protein, 35 aa, Homo sapiens
CSKDQFRCSNGQCIPAKWKCDGHEDCKYGEDEKSC

SEQ ID NO: 224 - protein, 35 aa, Homo sapiens
CSSREYICASDGCISASLKCNGEYDCADGSDEMDC

SEQ ID NO: 225 - protein, 36 aa, Homo sapiens
CKEDQFRCKNKAHCIPIRWLCDGIHDCVDGSDEENC

SEQ ID NO: 226 - protein, 37 aa, Homo sapiens
CRADEFLCNNSLCKLHFWVCDGEDDCGDNSDEAPDMC

SEQ ID NO: 227 - protein, 37 aa, Homo sapiens
CPSTRPHRCRNNRICLQSEQMCNGIDECGDNSDEDHC

SEQ ID NO: 228 - protein, 35 aa, Homo sapiens
CKKDEFACSNKKCIPMDLQCDRLDDCGDGSDEQGC

SEQ ID NO: 229 - protein, 37 aa, Homo sapiens
CAEGEALCQENGHCVPHGWLCDNQDDCGDGSDEEGEC

SEQ ID NO: 230 - protein, 37 aa, Homo sapiens
CGEGQMTCSSGHCLPLALLCDRQDDCGDGTDEPSYPC

SEQ ID NO: 231 - protein, 35 aa, Homo sapiens
CPQGLLACADGRCLPPALLCDGHPDCLDAADEESC

SEQ ID NO: 232 - protein, 37 aa, Homo sapiens
CVPGEVSCVDGTCLGAIQLCDGVWDCPDGADEGPGHC

SEQ ID NO: 233 - protein, 35 aa, Homo sapiens
CGPFEFRCGSGECTPRGWRCDQEEDCADGSDERGC

SEQ ID NO: 234 - protein, 38 aa, Homo sapiens
CAPHHAPCARGPHCVSPEQLCDGVRQCPDGSDEGPDAC

SEQ ID NO: 235 - protein, 36 aa, Homo sapiens
CPGLFPCGVAPGLCLTPEQLCDGIPDCPQGEDELDC

SEQ ID NO: 236 - protein, 39 aa, Homo sapiens
CPEYTCPNGTCIGFQLVCDGQPDCGRPGQVGPSPEEQGC

SEQ ID NO: 237 - protein, 36 aa, Homo sapiens
CEPGVGLRCASGECVLRGGPCDGVLDCEDGSDEEGC

SEQ ID NO: 238 - protein, 35 aa, Homo sapiens
CGPGQTPCEVLGCVEQAQVCDGREDCLDGSDERHC

SEQ ID NO: 239 - protein, 35 aa, Homo sapiens
CSPSQLSCGSGECLSAERRCDLRPDCQDGSDEDGC

SEQ ID NO: 240 - protein, 33 aa, Homo sapiens
CKFTCTSGKCLYLGSLVCNQQNDCGDNSDEENC

SEQ ID NO: 241 - protein, 36 aa, Homo sapiens
CPPTKFQCRTSGLCVPLTWRCDRDLDCSDGSDEEEC

SEQ ID NO: 242 - protein, 36 aa, Homo sapiens
CLAGELRCTLSDDCIPLTWRCDGHPDCPDSSDELGC

SEQ ID NO: 243 - protein, 36 aa, Homo sapiens
CSLGYFPCGNITKCLPQLLHCNGVDDCGNQADEDNC

SEQ ID NO: 244 - protein, 35 aa, Homo sapiens
CAHDEFRCDQLICLLPDSVCDGFANCADGSDETNC

SEQ ID NO: 245 - protein, 34 aa, Homo sapiens
CGPSELSCQAGGCKGVQWMCDMWRDCTDGSDDNC

SEQ ID NO: 246 - protein, 35 aa, Homo sapiens
CSRYHFFCDDGCCIDITLACDGVQQCPDGSDEDFC

SEQ ID NO: 247 - protein, 32 aa, Homo sapiens
CPGEFLCSVNGLCVPACDGVKDCPNGLDERNC

SEQ ID NO: 248 - protein, 35 aa, Homo sapiens
CRATFQCKEDSTCISLPKVCDGQPDCLNGSDEEQC

SEQ ID NO: 249 - protein, 36 aa, Homo sapiens
CGTFTFQCEDRSCVKKPNPQCDGRPDCRDGSDEEHC

SEQ ID NO: 250 - protein, 36 aa, Homo sapiens
CQKGYFPCGNLTKCLPRAFHCDGKDDCGNGADEENC

SEQ ID NO: 251 - protein, 35 aa, Homo sapiens
CSTARYHCKNGLCIDKSFICDGQNNCQDNSDEESC

SEQ ID NO: 252 - protein, 36 aa, Homo sapiens
CGPTFFPCASGIHCIIGRFRCNGFEDCPDGSDEENC

SEQ ID NO: 253 - protein, 36 aa, Homo sapiens
CNIPGNFMCSNGRCIPGAWQCDGLPDCFDKSDEKEC

SEQ ID NO: 254 - protein, 38 aa, Homo sapiens
CALDQFLCWNGRCIGQRKLCNGVNDCGDNSDESPQQNC

SEQ ID NO: 255 - protein, 34 aa, Homo sapiens
CEEDEFPCQNGYCIRSLWHCDGDNDCGDNSDEQC

SEQ ID NO: 256 - protein, 35 aa, Homo sapiens
CRSGEFMCDSGLCINAGWRCDGDADCDDQSDERNC

SEQ ID NO: 257 - protein, 35 aa, Homo sapiens
CTAEQFRCHSGRCVRLSWRCDGEDDCADNSDEENC

SEQ ID NO: 258 - protein, 35 aa, Homo sapiens
CSPLDFHCDNGKCIRRSWVCDGDNDCEDDSDEQDC

SEQ ID NO: 259 - protein, 35 aa, Homo sapiens
CNLEEFQCAYGRCILDIYHCDGDDDCGDWSDESDC

SEQ ID NO: 260 - protein, 35 aa, Homo sapiens
CSDKEFRCSDGSCIAEHWYCDGDTDCKDGSDEENC

SEQ ID NO: 261 - protein, 40 aa, Homo sapiens
CGRSHFTCAVSALGECTCIPAQWQCDGDNDCGDHSDEDGC

SEQ ID NO: 262 - protein, 35 aa, Homo sapiens
CLQEEFQCLNHRCVSAVQRCDGVDACGDGSDEAGC

SEQ ID NO: 263 - protein, 41 aa, Homo sapiens
CPPGHFPCGAAGTSGATACYLPADRCNYQTFCADGADERRC

SEQ ID NO: 264 - protein, 35 aa, Homo sapiens
CQPGNFRCRDEKCVYETWVCDGQPDCADGSDEWDC

SEQ ID NO: 265 - protein, 36 aa, Homo sapiens
CPEITDFLCRDKKCIASHLLCDYKPDCSDRSDEAHC

SEQ ID NO: 266 - protein, 36 aa, Homo sapiens
CNNRTFKCGNDICFRKQNAKCDGTVDCPDGSDEEGC

SEQ ID NO: 267 - protein, 37 aa, Homo sapiens
CPPGHHHCQNKVCVEPQQLCDGEDNCGDLSDENPLTC

SEQ ID NO: 268 - protein, 34 aa, Homo sapiens
CKQGHLACGDLCVPPEQLCDFEEQCAGGEDEQAC

SEQ ID NO: 269 - protein, 36 aa, Homo sapiens
CPGNSFSCGNSQCVTKVNPECDDQEDCSDGSDEAHC

SEQ ID NO: 270 - protein, 119 aa, Artificial Sequence; identical to SEQ ID NO: 14
  Description of Artificial Sequence: Synthetic polypeptide

SEQ ID NO: 271 - protein, 119 aa, Artificial Sequence; identical to SEQ ID NO: 15
  Description of Artificial Sequence: Synthetic polypeptide

SEQ ID NO: 272 - protein, 119 aa, Artificial Sequence; identical to SEQ ID NO: 16
  Description of Artificial Sequence: Synthetic polypeptide

SEQ ID NO: 273 - protein, 119 aa, Artificial Sequence; identical to SEQ ID NO: 17
  Description of Artificial Sequence: Synthetic polypeptide

SEQ ID NO: 274 - protein, 121 aa, Artificial Sequence; identical to SEQ ID NO: 18
  Description of Artificial Sequence: Synthetic polypeptide

SEQ ID NO: 275 - protein, 119 aa, Artificial Sequence; identical to SEQ ID NO: 19
  Description of Artificial Sequence: Synthetic polypeptide

SEQ ID NO: 276 - protein, 119 aa, Artificial Sequence; identical to SEQ ID NO: 20
  Description of Artificial Sequence: Synthetic polypeptide

SEQ ID NO: 277 - protein, 119 aa, Artificial Sequence; identical to SEQ ID NO: 21
  Description of Artificial Sequence: Synthetic polypeptide

SEQ ID NO: 278 - protein, 120 aa, Artificial Sequence; identical to SEQ ID NO: 22
  Description of Artificial Sequence: Synthetic polypeptide

SEQ ID NO: 279 - protein, 29 aa, Artificial Sequence
  Description of Artificial Sequence: Synthetic polypeptide
  MOD_RES (1)..(1): Glu or Gln
  MOD_RES (3)..(3): Variable amino acid
  MOD_RES (6)..(6): Variable amino acid
  MOD_RES (7)..(7): Ser or Thr
  MOD_RES (8)..(8): Variable amino acid
  MOD_RES (11)..(11): Ile or Val
  MOD_RES (12)..(14): Variable amino acid
  MOD_RES (16)..(16): Ile, Leu or Val
  MOD_RES (20)..(21): Variable amino acid
  MOD_RES (24)..(24): Variable amino acid
  MOD_RES (26)..(26): Asp or Asn
XFXCRXXXRCXXXXWXCDGXXDCXDXSDE

SEQ ID NO: 280 - protein, 26 aa, Artificial Sequence
  Description of Artificial Sequence: Synthetic polypeptide
  MOD_RES (2)..(2): Variable amino acid
  MOD_RES (10)..(11): Variable amino acid
  MOD_RES (17)..(18): Variable amino acid
  MOD_RES (23)..(23): Variable amino acid
CXSSGRCIPXXWVCDGXXDCRDXSDE

SEQ ID NO: 281 - protein, 26 aa, Artificial Sequence
  Description of Artificial Sequence: Synthetic polypeptide
  MOD_RES (2)..(2): Variable amino acid
  MOD_RES (10)..(11): Variable amino acid
  MOD_RES (17)..(18): Variable amino acid
  MOD_RES (23)..(23): Variable amino acid
CXSSGRCIPXXWLCDGXXDCRDXSDE

SEQ ID NO: 282 - protein, 51 aa, Artificial Sequence
  Description of Artificial Sequence: Synthetic polypeptide
CRSSQFQCNDSRICIPGRWRCDGDNDCQDGSDETGCGDSHILPFSTPGPST

SEQ ID NO: 283 - protein, 48 aa, Artificial Sequence
  Description of Artificial Sequence: Synthetic polypeptide
CPAGEFPCKNGQCLPVTWLCDGVNDCLDGSDEKGCGRPGPGATSAPAA

SEQ ID NO: 284 - protein, 48 aa, Artificial Sequence
  Description of Artificial Sequence: Synthetic polypeptide
CPPDEFPCKNGQCIPQDWLCDGVNDCLDGSDEKDCGRPGPGATSAPAA

SEQ ID NO: 285 - protein, 41 aa, Artificial Sequence
  Description of Artificial Sequence: Synthetic polypeptide
CGAGQFPCKNGHCLPLNLLCDGVNDCEDNSDEPSELCKALT

SEQ ID NO: 286 - protein, 159 aa, Artificial Sequence
  Description of Artificial Sequence: Synthetic polypeptide
CLSSEFQCQSSGRCIPLAWVCDGDNDCRDDSDEKSCKPRTCLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHT

SEQ ID NO: 287 - protein, 159 aa, Artificial Sequence
  Description of Artificial Sequence: Synthetic polypeptide
CLSSEFQCQSSGRCIPLAWVCDGDNDCRDDSDEKSCKPRTCLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 288 - protein, 159 aa, Artificial Sequence
  Description of Artificial Sequence: Synthetic polypeptide
CLSSEFQCQSSGRCIPLAWVCDGDNDCRDDSDEKSCKPRTCRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 289 - protein, 159 aa, Artificial Sequence
  Description of Artificial Sequence: Synthetic polypeptide
CLSSEFQCQSSGRCIPLAWVCDGDNDCRDDSDEKSCKPRTCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHT

SEQ ID NO: 290 - protein, 161 aa, Artificial Sequence
  Description of Artificial Sequence: Synthetic polypeptide
CLSSEFQCQSSGRCIPLAWVCDGDNDCRDDSDEKSCKPRTCQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPT

SEQ ID NO: 291 - protein, 159 aa, Artificial Sequence
  Description of Artificial Sequence: Synthetic polypeptide
CLSSEFQCQSSGRCIPLAWVCDGDNDCRDDSDEKSCKPRTCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPT

SEQ ID NO: 292 - protein, 159 aa, Artificial Sequence
  Description of Artificial Sequence: Synthetic polypeptide
CLSSEFQCQSSGRCIPLAWVCDGDNDCRDDSDEKSCKPRTCLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHT

SEQ ID NO: 293 - protein, 159 aa, Artificial Sequence
  Description of Artificial Sequence: Synthetic polypeptide
CLSSEFQCQSSGRCIPLAWVCDGDNDCRDDSDEKSCKPRTCESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHT

SEQ ID NO: 294 - protein, 160 aa, Artificial Sequence
  Description of Artificial Sequence: Synthetic polypeptide
CLSSEFQCQSSGRCIPLAWVCDGDNDCRDDSDEKSCKPRTCGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPART

SEQ ID NO: 295 - protein, 160 aa, Artificial Sequence
  Description of Artificial Sequence: Synthetic polypeptide
CHPTGQFRCRSSGRCVSPTWVCDGDNDCGDNSDEENCKPRTCLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHT

SEQ ID NO: 296 - protein, 160 aa, Artificial Sequence
  Description of Artificial Sequence: Synthetic polypeptide
CHPTGQFRCRSSGRCVSPTWVCDGDNDCGDNSDEENCKPRTCLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 297 - protein, 160 aa, Artificial Sequence
  Description of Artificial Sequence: Synthetic polypeptide
CHPTGQFRCRSSGRCVSPTWVCDGDNDCGDNSDEENCKPRTCRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 298 - protein, 160 aa, Artificial Sequence
  Description of Artificial Sequence: Synthetic polypeptide
CHPTGQFRCRSSGRCVSPTWVCDGDNDCGDNSDEENCKPRTCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHT

SEQ ID NO: 299 - protein, 162 aa, Artificial Sequence
  Description of Artificial Sequence: Synthetic polypeptide
CHPTGQFRCRSSGRCVSPTWVCDGDNDCGDNSDEENCKPRTCQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPT

SEQ ID NO: 300 - protein, 160 aa, Artificial Sequence
  Description of Artificial Sequence: Synthetic polypeptide
CHPTGQFRCRSSGRCVSPTWVCDGDNDCGDNSDEENCKPRTCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPT

SEQ ID NO: 301 - protein, 160 aa, Artificial Sequence
  Description of Artificial Sequence: Synthetic polypeptide
CHPTGQFRCRSSGRCVSPTWVCDGDNDCGDNSDEENCKPRTCLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHT

SEQ ID NO: 302 - protein, 160 aa, Artificial Sequence
  Description of Artificial Sequence: Synthetic polypeptide
CHPTGQFRCRSSGRCVSPTWVCDGDNDCGDNSDEENCKPRTCESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHT

SEQ ID NO: 303 - protein, 161 aa, Artificial Sequence
  Description of Artificial Sequence: Synthetic polypeptide
CHPTGQFRCRSSGRCVSPTWVCDGDNDCGDNSDEENCKPRTCGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPART

SEQ ID NO: 304 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHT

SEQ ID NO: 305 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 306 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 307 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHT

SEQ ID NO: 308 - protein, 168 aa, Artificial Sequence
  Description of Artificial Sequence: Synthetic polypeptide
CLSSEFQCQSSGRCIPLAWVCDGDNDCRDDSDEKSCSAPASEPPGSLCQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPT

SEQ ID NO: 309 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPT

SEQ ID NO: 310 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHT

SEQ ID NO: 311 - protein, 166 aa, Artificial Sequence
  Description of Artificial Sequence: Synthetic polypeptide
CLSSEFQCQSSGRCIPLAWVCDGDNDCRDDSDEKSCSAPASEPPGSLCESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHT

SEQ ID NO: 312 - protein, 167 aa, Artificial Sequence
  Description of Artificial Sequence: Synthetic polypeptide
CLSSEFQCQSSGRCIPLAWVCDGDNDCRDDSDEKSCSAPASEPPGSLCGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPART

SEQ ID NO: 313 - protein, 167 aa, Artificial Sequence; identical to SEQ ID NO: 5
  Description of Artificial Sequence: Synthetic polypeptide

SEQ ID NO: 314 - protein, 167 aa, Artificial Sequence; identical to SEQ ID NO: 6
  Description of Artificial Sequence: Synthetic polypeptide

SEQ ID NO: 315 - protein, 167 aa, Artificial Sequence; identical to SEQ ID NO: 7
  Description of Artificial Sequence: Synthetic polypeptide

SEQ ID NO: 316 - protein, 167 aa, Artificial Sequence; identical to SEQ ID NO: 8
  Description of Artificial Sequence: Synthetic polypeptide

SEQ ID NO: 317 - protein, 169 aa, Artificial Sequence; identical to SEQ ID NO: 9
  Description of Artificial Sequence: Synthetic polypeptide

SEQ ID NO: 318 - protein, 167 aa, Artificial Sequence; identical to SEQ ID NO: 10
  Description of Artificial Sequence: Synthetic polypeptide

SEQ ID NO: 319 - protein, 167 aa, Artificial Sequence; identical to SEQ ID NO: 11
  Description of Artificial Sequence: Synthetic polypeptide

SEQ ID NO: 320 - protein, 167 aa, Artificial Sequence; identical to SEQ ID NO: 12
  Description of Artificial Sequence: Synthetic polypeptide

SEQ ID NO: 321 - protein, 168 aa, Artificial Sequence; identical to SEQ ID NO: 13
  Description of Artificial Sequence: Synthetic polypeptide

SEQ ID NO: 322 - protein, 159 aa, Artificial Sequence
  Description of Artificial Sequence: Synthetic polypeptide
CLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHTCLSSEFQCQSSGRCIPLAWVCDGDNDCRDDSDEKSCKPRT

SEQ ID NO: 323 - protein, 159 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHTCLSSEFQCQSSGRCIPLAWVCDGDNDCRDDSDEKSCKPRT

SEQ ID NO: 324 - protein, 159 aa, Artificial Sequence
  Description of Artificial Sequence: Synthetic polypeptide
CRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHTCLSSEFQCQSSGRCIPLAWVCDGDNDCRDDSDEKSCKPRT

SEQ ID NO: 325 - protein, 159 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHTCLSSEFQCQSSGRCIPLAWVCDGDNDCRDDSDEKSCKPRT

SEQ ID NO: 326 - protein, 161 aa, Artificial Sequence
  Description of Artificial Sequence: Synthetic polypeptide
CQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPTCLSSEFQCQSSGRCIPLAWVCDGDNDCRDDSDEKSCKPRT

SEQ ID NO: 327 - protein, 159 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPTCLSSEFQCQSSGRCIPLAWVCDGDNDCRDDSDEKSCKPRT

SEQ ID NO: 328 - protein, 159 aa, Artificial Sequence
  Description of Artificial Sequence: Synthetic polypeptide
CLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHTCLSSEFQCQSSGRCIPLAWVCDGDNDCRDDSDEKSCKPRT

SEQ ID NO: 329 - protein, 159 aa, Artificial Sequence
  Description of Artificial Sequence: Synthetic polypeptide
CESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHTCLSSEFQCQSSGRCIPLAWVCDGDNDCRDDSDEKSCKPRT

SEQ ID NO: 330 - protein, 160 aa, Artificial Sequence
  Description of Artificial Sequence: Synthetic polypeptide
CGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPARTCLSSEFQCQSSGRCIPLAWVCDGDNDCRDDSDEKSCKPRT

SEQ ID NO: 331 - protein, 167 aa, Artificial Sequence
  Description of Artificial Sequence: Synthetic polypeptide
CLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHTCHPTGQFRCRSSGRCVSPTWVCDGDNDCGDNSDEENCSAPASEPPGSL

SEQ ID NO: 332 - protein, 167 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHTCHPTGQFRCRSSGRCVSPTWVCDGDNDCGDNSDEENCSAPASEPPGSL

SEQ ID NO: 333 - protein, 167 aa, Artificial Sequence
  Description of Artificial Sequence: Synthetic polypeptide
CRADEFQCGSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHTCHPTGQFRCRSSGRCVSPTWVCDGDNDCGDNSDEENCSAPASEPPGSL

SEQ ID NO: 334 - protein, 167 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEEDCTQHTCHPTGQFRCRSSGRCVSPTWVCDGDNDCGDNSDEENCSAPASEPPGSL

SEQ ID NO: 335 - protein, 169 aa, Artificial Sequence
  Description of Artificial Sequence: Synthetic polypeptide
CQANEFTCSSGNCLSPALLCDGVDDCGDNSDETYCASPAPTCLPSQFQCGSGYCISQRWVCDGENDCEDSSDEANCAGSVPTCQPGEFTCESGRCLPLRWLCDGEDDCVDSSDEASCQPPTCHPTGQFRCRSSGRCVSPTWVCDGDNDCGDNSDEENCSAPASEPPGSL

SEQ ID NO: 336 - protein, 167 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCIPRAWRCDGVNDCADNSDEADCAAPTCHPTGQFRCRSSGRCVSPTWVCDGDNDCGDNSDEENCSAPASEPPGSL

SEQ ID NO: 337 - protein, 167 aa, Artificial Sequence
  Description of Artificial Sequence: Synthetic polypeptide
CLPDQFRCGNGQCIPLDWVCDGVNDCEDDSDEESCPPHTCLPDQFQCGSGYCLSQRWVCDGENDCEDGSDEANCAGSVPTCPSDEFRCRNGRCIPRAWRCDGVNDCADNSDEEDCTEHTCHPTGQFRCRSSGRCVSPTWVCDGDNDCGDNSDEENCSAPASEPPGSL

SEQ ID NO: 338 - protein, 167 aa, Artificial Sequence
  Description of Artificial Sequence: Synthetic polypeptide
CESDQFQCDSGHCVPLNWVCDGVNDCVDGSDEAGCPPRTCLPGQFQCGSGYCISQRWVCDGENDCEDGSDEANCAGSVPTCPSDEFRCRNGRCIPRAWRCDGVNDCADNSDEEDCTEHTCHPTGQFRCRSSGRCVSPTWVCDGDNDCGDNSDEENCSAPASEPPGSL

SEQ ID NO: 339 - protein, 168 aa, Artificial Sequence
  Description of Artificial Sequence: Synthetic polypeptide
CGASQFQCGSGYCISQRWVCDGENDCEDSSDEANCAGSVPTCLPSEFQCRDSKICLSADWLCDGVNDCADNSDEEGCPPPTCLPDQFQCGSGYCLPQAWVCDGENDCEDGSDETNCPARTCHPTGQFRCRSSGRCVSPTWVCDGDNDCGDNSDEENCSAPASEPPGSL

SEQ ID NO: 340 - protein, 27 aa, Artificial Sequence
  Description of Artificial Sequence: Synthetic polypeptide
  MOD_RES (2)..(2): Val, Ile, Leu, Met or Ala
  MOD_RES (3)..(7): Variable amino acid
  MOD_RES (9)..(9): Asp, Asn or His
  MOD_RES (10)..(12): Variable amino acid
  MOD_RES (13)..(13): Asp, Glu, Asn, Gln, His or Thr
  MOD_RES (15)..(18): Variable amino acid and this region may encompass 3 or 4 residues
  MOD_RES (19)..(19): Ser, Thr, Ala, Asp or Glu
  MOD_RES (20)..(20): Asp, Glu or His
  MOD_RES (21)..(21): Asp or Glu
  MOD_RES (22)..(26): Variable amino acid and this region may encompass 1 to 5 residues
CXXXXXXCXXXXXCXXXXXXXXXXXXC

SEQ ID NO: 341 - protein, 64 aa, Artificial Sequence
  Description of Artificial Sequence: Synthetic polypeptide
  MOD_RES (2)..(16): Variable amino acid and this region may encompass 3 to 15 residues
  MOD_RES (18)..(32): Variable amino acid and this region may encompass 4 to 15 residues
  MOD_RES (34)..(40): Variable amino acid and this region may encompass 6 or 7 residues
  MOD_RES (42)..(42): Asn or Asp
  MOD_RES (43)..(45): Variable amino acid
  MOD_RES (46)..(46): Asp, Glu, Asn, Gln, His, Ser or Thr
  MOD_RES (48)..(53): Variable amino acid and this region may encompass 4 to 6 residues
  MOD_RES (56)..(63): Variable amino acid and this region may encompass 2 to 8 residues
CXXXXXXXXXXXXXXXCXXXXXXXXXXXXXXXCXXXXXXXCXXXXXCXXXXXXDEXXXXXXXXC

SEQ ID NO: 342 - protein, 64 aa, Artificial Sequence; identical to SEQ ID NO: 341
  Description of Artificial Sequence: Synthetic polypeptide
  MOD_RES (2)..(16): Variable amino acid and this region may encompass 3 to 15 residues
  MOD_RES (18)..(32): Variable amino acid and this region may encompass 3 to 15 residues
  MOD_RES (34)..(40): Variable amino acid and this region may encompass 6 or 7 residues
  MOD_RES (42)..(42): Asp or Asn
  MOD_RES (43)..(46): Variable amino acid
  MOD_RES (48)..(53): Variable amino acid and this region may encompass 4 to 6 residues
  MOD_RES (56)..(63): Variable amino acid and this region may encompass 2 to 8 residues

SEQ ID NO: 343 - protein, 68 aa, Artificial Sequence
  Description of Artificial Sequence: Synthetic polypeptide
  MOD_RES (2)..(15): Variable amino acid and this region may encompass 3 to 14 residues
  MOD_RES (17)..(23): Variable amino acid and this region may encompass 3 to 7 residues
  MOD_RES (25)..(40): Variable amino acid and this region may encompass 4 to 16 residues
  MOD_RES (42)..(43): Variable amino acid and this region may encompass 1 or 2 residues
  MOD_RES (45)..(67): Variable amino acid and this region may encompass 8 to 23 residues
CXXXXXXXXXXXXXXCXXXXXXXCXXXXXXXXXXXXXXXXCXXCXXXXXXXXXXXXXXXXXXXXXXXC

SEQ ID NO: 344 - protein, 53 aa, Artificial Sequence
  Description of Artificial Sequence: Synthetic polypeptide
  MOD_RES (1)..(6): Variable amino acid that may or may not be present
  MOD_RES (8)..(10): Variable amino acid
  MOD_RES (12)..(16): Variable amino acid
  MOD_RES (17)..(17): Variable amino acid that may or may not be present
  MOD_RES (18)..(22): Variable amino acid
  MOD_RES (24)..(27): Variable amino acid
  MOD_RES (28)..(30): Variable amino acid that may or may not be present
  MOD_RES (31)..(35): Variable amino acid
  MOD_RES (37)..(42): Variable amino acid
  MOD_RES (43)..(43): Variable amino acid that may or may not be present
  MOD_RES (44)..(46): Variable amino acid
  MOD_RES (48)..(48): Variable amino acid that may or may not be present
  MOD_RES (49)..(52): Variable amino acid
XXXXXXCXXXCXXXXXXXXXXXCXXXXXXXXXXXXCXXXXXXXXXXCXXXXXC

SEQ ID NO: 345 - protein, 53 aa, Artificial Sequence
  Description of Artificial Sequence: Synthetic polypeptide
  MOD_RES (1)..(1): May or may not be present
  MOD_RES (2)..(3): Variable amino acid that may or may not be present
  MOD_RES (4)..(4): May or may not be present
  MOD_RES (5)..(6): Variable amino acid that may or may not be present
  MOD_RES (8)..(10): Variable amino acid
  MOD_RES (12)..(13): Variable amino acid
  MOD_RES (15)..(16): Variable amino acid
  MOD_RES (17)..(17): Variable amino acid that may or may not be present
  MOD_RES (18)..(18): Variable amino acid
  MOD_RES (20)..(22): Variable amino acid
  MOD_RES (24)..(27): Variable amino acid
  MOD_RES (28)..(28): May or may not be present
  MOD_RES (29)..(30): Variable amino acid that may or may not be present
  MOD_RES (31)..(35): Variable amino acid
  MOD_RES (37)..(42): Variable amino acid
  MOD_RES (43)..(43): Variable amino acid that may or may not be present
  MOD_RES (44)..(46): Variable amino acid
  MOD_RES (48)..(48): Variable amino acid that may or may not be present
  MOD_RES (49)..(52): Variable amino acid
WXXWXXCXXXCXXGXXXXRXXXCXXXXPXXXXXXXCXXXXXXXXXXCXXXXXC

SEQ ID NO: 346 - protein, 53 aa, Artificial Sequence
  Description of Artificial Sequence: Synthetic polypeptide
  MOD_RES (1)..(1): May or may not be present
  MOD_RES (2)..(3): Variable amino acid that may or may not be present
  MOD_RES (4)..(4): May or may not be present
  MOD_RES (5)..(6): Variable amino acid that may or may not be present
  MOD_RES (9)..(9): Variable amino acid
  MOD_RES (12)..(13): Variable amino acid
  MOD_RES (15)..(16): Variable amino acid
  MOD_RES (17)..(17): Variable amino acid that may or may not be present
  MOD_RES (18)..(18): Variable amino acid
  MOD_RES (20)..(20): Variable amino acid
  MOD_RES (22)..(22): Variable amino acid
  MOD_RES (24)..(27): Variable amino acid
  MOD_RES (28)..(28): May or may not be present
  MOD_RES (29)..(30): Variable amino acid that may or may not be present
  MOD_RES (31)..(35): Variable amino acid
  MOD_RES (37)..(42): Variable amino acid
  MOD_RES (43)..(43): Variable amino acid that may or may not be present
  MOD_RES (44)..(46): Variable amino acid
  MOD_RES (48)..(48): Variable amino acid that may or may not be present
  MOD_RES (49)..(52): Variable amino acid
WXXWXXCSXTCXXGXXXXRXRXCXXXXPXXXXXXXCXXXXXXXXXXCXXXXXC

SEQ ID NO: 347 - protein, 53 aa, Artificial Sequence
  Description of Artificial Sequence: Synthetic polypeptide
  MOD_RES (1)..(1): May or may not be present
  MOD_RES (2)..(3): Variable amino acid that may or may not be present
  MOD_RES (4)..(4): May or may not be present
  MOD_RES (5)..(6): Variable amino acid that may or may not be present
  MOD_RES (8)..(8): Ser, Thr, Asn or Asp
  MOD_RES (9)..(9): Val, Lys, Ala or Gln
  MOD_RES (10)..(10): Thr, Ser, Pro or Leu
  MOD_RES (12)..(13): Variable amino acid
  MOD_RES (14)..(14): Gly or Gln
  MOD_RES (15)..(16): Variable amino acid
  MOD_RES (17)..(17): Variable amino acid that may or may not be present
  MOD_RES (18)..(18): Variable amino acid
  MOD_RES (19)..(19): Arg or Glu
  MOD_RES (20)..(20): Variable amino acid
  MOD_RES (21)..(21): Arg, Lys, Thr, Val or Met
  MOD_RES (22)..(22): Variable amino acid
  MOD_RES (23)..(23): Cys, Val, Leu, Asp or Arg
  MOD_RES (24)..(27): Variable amino acid
  MOD_RES (28)..(28): Pro, Gln or not present
  MOD_RES (29)..(30): Variable amino acid that may or may not be present
  MOD_RES (31)..(35): Variable amino acid
  MOD_RES (36)..(36): Cys, Leu, Asp, Ala or Glu
  MOD_RES (37)..(42): Variable amino acid
  MOD_RES (43)..(43): Variable amino acid that may or may not be present
  MOD_RES (44)..(46): Variable amino acid
  MOD_RES (48)..(48): Variable amino acid that may or may not be present
  MOD_RES (49)..(52): Variable amino acid
WXXWXXCXXXCXXXXXXXXXXXXXXXXXXXXXXXXXXXXXXXXXXXCXXXXXC

SEQ ID NO: 348 - protein, 53 aa, Artificial Sequence; identical to SEQ ID NO: 347
  Description of Artificial Sequence: Synthetic polypeptide
  MOD_RES (1)..(1): May or may not be present
  MOD_RES (2)..(3): Variable amino acid that may or may not be present
  MOD_RES (4)..(4): May or may not be present
  MOD_RES (5)..(6): Variable amino acid that may or may not be present
  MOD_RES (8)..(8): Ser, Thr, Asn or Asp
  MOD_RES (9)..(9): Val, Lys, Ala or Gln
  MOD_RES (10)..(10): Thr, Ser, Pro or Leu
  MOD_RES (12)..(13): Variable amino acid
  MOD_RES (14)..(14): Gly or Gln
  MOD_RES (15)..(16): Variable amino acid
  MOD_RES (17)..(17): Variable amino acid that may or may not be present
  MOD_RES (18)..(18): Variable amino acid
  MOD_RES (19)..(19): Arg or Glu
  MOD_RES (20)..(20): Variable amino acid
  MOD_RES (21)..(21): Arg, Lys, Thr, Val or Met
  MOD_RES (22)..(22): Variable amino acid
  MOD_RES (23)..(23): Cys, Val, Leu, Asp or Arg
  MOD_RES (24)..(27): Variable amino acid
  MOD_RES (28)..(28): Pro, Gln or not present
  MOD_RES (29)..(30): Variable amino acid that may or may not be present
  MOD_RES (31)..(35): Variable amino acid
  MOD_RES (36)..(36): Cys, Leu, Asp, Ala or Glu
  MOD_RES (37)..(42): Variable amino acid
  MOD_RES (43)..(43): Variable amino acid that may or may not be present
  MOD_RES (44)..(46): Variable amino acid
  MOD_RES (48)..(48): Variable amino acid that may or may not be present
  MOD_RES (49)..(52): Variable amino acid

SEQ ID NO: 349 - protein, 50 aa, Artificial Sequence
  Description of Artificial Sequence: Synthetic polypeptide
  MOD_RES (2)..(2): Asn, Ser or Thr
  MOD_RES (3)..(3): Ala, Glu, Gly, Ile, Lys, Leu, Gln, Arg, Ser, Thr or Val
  MOD_RES (4)..(4): Ala, Asp, Glu, Asn, Pro, Gln, Arg, Ser or Thr
  MOD_RES (6)..(6): Ala, Asp, Glu, Thr, Gly or Ser
  MOD_RES (7)..(7): Variable amino acid
  MOD_RES (9)..(9): Variable amino acid
  MOD_RES (10)..(10): Ile, Lys, Gln, Arg, Ser, Thr or Val
  MOD_RES (11)..(11): Variable amino acid
  MOD_RES (12)..(12): Ala, Gln, Arg, Ser or Thr
  MOD_RES (13)..(13): Variable amino acid
  MOD_RES (14)..(14): Ala, Leu, Met, Arg, Thr or Val
  MOD_RES (15)..(15): Variable amino acid
  MOD_RES (17)..(25): Variable amino acid
  MOD_RES (26)..(32): Variable amino acid that may or may not be present
  MOD_RES (34)..(42): Variable amino acid
  MOD_RES (43)..(44): Variable amino acid that may or may not be present
  MOD_RES (46)..(49): Variable amino acid
CXXXCXXGXXXXXXXCXXXXXXXXXXXXXXXXCXXXXXXXXXXXCXXXXC

SEQ ID NO: 350 - protein, 42 aa, Artificial Sequence
  Description of Artificial Sequence: Synthetic polypeptide
  MOD_RES (2)..(3): Variable amino acid that may or may not be present
  MOD_RES (4)..(12): Variable amino acid
  MOD_RES (14)..(15): Variable amino acid
  MOD_RES (16)..(16): Variable amino acid that may or may not be present
  MOD_RES (17)..(23): Variable amino acid
  MOD_RES (25)..(28): Variable amino acid
  MOD_RES (31)..(35): Variable amino acid
  MOD_RES (36)..(36): Variable amino acid that may or may not be present
  MOD_RES (37)..(41): Variable amino acid
CXXXXXXXXXXXCXXXXXXXXXXCXXXXCCXXXXXXXXXXXC

SEQ ID NO: 351 - protein, 42 aa, Artificial Sequence
  Description of Artificial Sequence: Synthetic polypeptide
  MOD_RES (2)..(3): Variable amino acid that may or may not be present
  MOD_RES (4)..(9): Variable amino acid
  MOD_RES (11)..(12): Variable amino acid
  MOD_RES (14)..(15): Variable amino acid
  MOD_RES (16)..(16): Variable amino acid that may or may not be present
  MOD_RES (17)..(23): Variable amino acid
  MOD_RES (25)..(28): Variable amino acid
  MOD_RES (31)..(35): Variable amino acid
  MOD_RES (36)..(36): Variable amino acid that may or may not be present
  MOD_RES (37)..(41): Variable amino acid
CXXXXXXXXRXXCXXXXXXXXXXCXXXXCCXXXXXXXXXXXC

SEQ ID NO: 352 - protein, 43 aa, Artificial Sequence
  Description of Artificial Sequence: Synthetic polypeptide
  MOD_RES (2)..(3): Variable amino acid that may or may not be present
  MOD_RES (4)..(6): Variable amino acid
  MOD_RES (8)..(9): Variable amino acid
  MOD_RES (11)..(11): Variable amino acid
  MOD_RES (15)..(15): Variable amino acid
  MOD_RES (16)..(16): Variable amino acid that may or may not be present
  MOD_RES (18)..(18): Variable amino acid
  MOD_RES (21)..(23): Variable amino acid
  MOD_RES (25)..(27): Variable amino acid
  MOD_RES (33)..(35): Variable amino acid
  MOD_RES (36)..(36): Variable amino acid that may or may not be present
  MOD_RES (37)..(39): Variable amino acid
CXXXXXPXXRXNCGXXPXITXXXCXXXGCCFDXXXXXXXPWCF

SEQ ID NO: 353 - protein, 44 aa, Artificial Sequence
  Description of Artificial Sequence: Synthetic polypeptide
  MOD_RES (2)..(3): Variable amino acid that may or may not be present
  MOD_RES (4)..(6): Variable amino acid
  MOD_RES (7)..(7): Pro, Val, Ala or Glu
  MOD_RES (8)..(9): Variable amino acid
  MOD_RES (11)..(11): Variable amino acid
  MOD_RES (12)..(12): Asn, Asp, Pro or Met
  MOD_RES (14)..(14): Gly, Ala, Ile or Tyr
  MOD_RES (15)..(15): Tyr, Pro, Phe, Ser or Thr
  MOD_RES (16)..(16): Asp, Glu or not present
  MOD_RES (17)..(17): Variable amino acid that may or may not be present
  MOD_RES (18)..(18): Pro, Ser, Lys or Gln
  MOD_RES (19)..(19): Variable amino acid
  MOD_RES (20)..(20): Ile, Val, Ala or Pro
  MOD_RES (21)..(21): Thr, Ser or Ala
  MOD_RES (22)..(23): Variable amino acid
  MOD_RES (24)..(24): Gln, Glu, Asp or Lys
  MOD_RES (26)..(27): Variable amino acid
  MOD_RES (28)..(28): Lys, Arg, Leu or Asn
  MOD_RES (29)..(29): Gly, Asn or Lys
  MOD_RES (32)..(32): Phe, Trp or Tyr
  MOD_RES (33)..(33): Asp, Asn, Arg or Ser
  MOD_RES (34)..(34): Ser, Asp, Pro, Asn, Thr or Glu
  MOD_RES (35)..(36): Variable amino acid
  MOD_RES (37)..(37): Variable amino acid that may or may not be present
  MOD_RES (38)..(40): Variable amino acid
  MOD_RES (41)..(41): Pro, Lys or Ile
  MOD_RES (42)..(42): Trp, Glu, Ala, Ser or His
  MOD_RES (44)..(44): Phe or Tyr
CXXXXXXXXRXXCXXXXXXXXXXXCXXXXCCXXXXXXXXXXXCX

SEQ ID NO: 354 - protein, 44 aa, Artificial Sequence; identical to SEQ ID NO: 353
  Description of Artificial Sequence: Synthetic polypeptide
  MOD_RES (2)..(3): Variable amino acid that may or may not be present
  MOD_RES (4)..(6): Variable amino acid
  MOD_RES (7)..(7): Pro, Val, Ala or Glu
  MOD_RES (8)..(9): Variable amino acid
  MOD_RES (11)..(11): Variable amino acid
  MOD_RES (12)..(12): Asn, Asp, Pro or Met
  MOD_RES (14)..(14): Gly, Ala, Ile or Tyr
  MOD_RES (15)..(15): Tyr, Pro, Phe, Ser or Thr
  MOD_RES (16)..(16): Asp, Glu or not present
  MOD_RES (17)..(17): Variable amino acid that may or may not be present
  MOD_RES (18)..(18): Pro, Ser, Lys or Gln
  MOD_RES (19)..(19): Variable amino acid
  MOD_RES (20)..(20): Ile, Val, Ala or Pro
  MOD_RES (21)..(21): Thr, Ser or Ala
  MOD_RES (22)..(23): Variable amino acid
  MOD_RES (24)..(24): Lys, Glu, Gln or Asp
  MOD_RES (26)..(27): Variable amino acid
  MOD_RES (28)..(28): Lys, Arg, Leu or Asn
  MOD_RES (29)..(29): Gly, Asn or Lys
  MOD_RES (32)..(32): Trp, Tyr, Phe or Leu
  MOD_RES (33)..(33): Asp, Asn, Arg or Ser
  MOD_RES (34)..(34): Ser, Asp, Pro, Asn, Thr or Glu
  MOD_RES (35)..(36): Variable amino acid
  MOD_RES (37)..(37): Variable amino acid that may or may not be present
  MOD_RES (38)..(40): Variable amino acid
  MOD_RES (41)..(41): Pro, Lys or Ile
  MOD_RES (42)..(42): Trp, Glu, Ala, Ser or His
  MOD_RES (44)..(44): Phe or Tyr

SEQ ID NO: 355 - protein, 38 aa, Artificial Sequence
  Description of Artificial Sequence: Synthetic polypeptide
  MOD_RES (2)..(2): Asp, Asn, Pro, Ser or not present
  MOD_RES (3)..(3): Ala, Asp, Ile, Lys, Leu, Asn, Pro, Arg, Ser, Thr or Val
  MOD_RES (4)..(4): Asp, Phe, Ile, Leu, Met or Val
  MOD_RES (5)..(5): Ala, Asp, Glu, Asn, Pro, Arg, Ser or Thr
  MOD_RES (6)..(6): Ala, Asp, Glu, Leu, Pro, Arg or Val
  MOD_RES (7)..(7): Glu, His, Lys, Leu, Asn, Gln, Arg or Ser
  MOD_RES (8)..(8): Ala, Asp, Glu, Gly, Lys, Asn, Ser or Val
  MOD_RES (9)..(9): Lys, Gln or Arg
  MOD_RES (10)..(10): Phe, Ile, Lys, Leu, Gln, Arg, Thr or Val
  MOD_RES (11)..(11): Asp, Asn, Pro, Gln or Ser
  MOD_RES (13)..(13): Ala, Gly, Ile or Tyr
  MOD_RES (14)..(14): Phe, Leu, Pro, Ser, Val or Tyr
  MOD_RES (15)..(15): Asp, Lys, Asn, Pro, Gln or Ser
  MOD_RES (16)..(16): Ala, Asp, Phe, Gly, His, Leu or Pro
  MOD_RES (17)..(17): Ala, Ile, Pro or Val
  MOD_RES (18)..(18): Ser or Thr
  MOD_RES (19)..(19): Ala, Glu, Gly, Lys, Pro, Gln, Arg or Ser
  MOD_RES (20)..(20): Ala, Asp, Glu, Gly, Lys, Pro, Gln or Ser
  MOD_RES (21)..(21): Asp, Glu, Ile, Lys, Asn, Gln or Thr
  MOD_RES (23)..(23): Ala, Asp, Glu, Phe, Lys, Asn, Gln, Arg or Thr
  MOD_RES (24)..(24): Ala, Asp, Glu, Gly, Lys, Asn, Gln or Ser
  MOD_RES (25)..(25): Gly or Asn
  MOD_RES (28)..(28): Trp, Tyr, Phe or His
  MOD_RES (29)..(29): Asp, Glu, Ile, Asn, Arg or Ser
  MOD_RES (30)..(30): Ala, Asp, Gly, Asn, Pro, Ser or Thr
  MOD_RES (31)..(31): Ala, Glu, Phe, Gly, Gln, Leu, Arg, Ser, Thr or Trp
  MOD_RES (32)..(32): Gly, Ile, Lys, Asn, Ser, Val, Met or Gln
  MOD_RES (33)..(33): Ala, Phe, Met, Pro, Arg, Ser, Thr, Val or not present
  MOD_RES (34)..(34): Asp, Glu, Gly, Lys, Leu, Asn, Ser or not present
  MOD_RES (35)..(35): Ala, Phe, Ile, Gln, Ser, Thr, Val or not present
  MOD_RES (36)..(36): Ile, Lys, Asn, Pro, Val or not present
  MOD_RES (37)..(37): May or may not be present
CXXXXXXXXXXCXXXXXXXXXCXXXCCXXXXXXXXXWC

SEQ ID NO: 356 - protein, 85 aa, Artificial Sequence
  Description of Artificial Sequence: Synthetic polypeptide
  MOD_RES (2)..(16): Variable amino acid
  MOD_RES (17)..(26): Variable amino acid that may or may not be present
  MOD_RES (27)..(37): Variable amino acid
  MOD_RES (39)..(48): Variable amino acid
  MOD_RES (50)..(50): Variable amino acid
  MOD_RES (51)..(51): Variable amino acid that may or may not be present
  MOD_RES (52)..(52): Variable amino acid
  MOD_RES (53)..(55): Variable amino acid that may or may not be present
  MOD_RES (56)..(59): Variable amino acid
  MOD_RES (61)..(61): Variable amino acid
  MOD_RES (63)..(66): Variable amino acid
  MOD_RES (67)..(67): Variable amino acid that may or may not be present
  MOD_RES (68)..(81): Variable amino acid
  MOD_RES (82)..(83): Variable amino acid that may or may not be present
  MOD_RES (84)..(84): Variable amino acid
CXXXXXXXXXXXXXXXXXXXXXXXXXXXXXXXXXXXXCXXXXXXXXXXCXXXXXXXXXXCXCXXXXXXXXXXXXXXXXXXXXXXC

SEQ ID NO: 357 - protein, 85 aa, Artificial Sequence
  Description of Artificial Sequence: Synthetic polypeptide
  MOD_RES (2)..(16): Variable amino acid
  MOD_RES (17)..(26): Variable amino acid that may or may not be present
  MOD_RES (27)..(33): Variable amino acid
  MOD_RES (35)..(35): Variable amino acid
  MOD_RES (37)..(37): Variable amino acid
  MOD_RES (39)..(41): Variable amino acid
  MOD_RES (43)..(47): Variable amino acid
  MOD_RES (50)..(50): Variable amino acid
  MOD_RES (51)..(51): Variable amino acid that may or may not be present
  MOD_RES (52)..(52): Variable amino acid
  MOD_RES (53)..(55): Variable amino acid that may or may not be present
  MOD_RES (56)..(59): Variable amino acid
  MOD_RES (64)..(66): Variable amino acid
  MOD_RES (67)..(67): Variable amino acid that may or may not be present
  MOD_RES (69)..(72): Variable amino acid
  MOD_RES (74)..(81): Variable amino acid
  MOD_RES (82)..(83): Variable amino acid that may or may not be present
  MOD_RES (84)..(84): Variable amino acid
CXXXXXXXXXXXXXXXXXXXXXXXXXXXXXXXXYXPXCXXXGXXXXXQCXXXXXXXXXXCWCVXXXXGXXXXGXXXXXXXXXXXC

SEQ ID NO: 358 - protein, 85 aa, Artificial Sequence
  Description of Artificial Sequence: Synthetic polypeptide
  MOD_RES (2)..(16): Variable amino acid
  MOD_RES (17)..(26): Variable amino acid that may or may not be present
  MOD_RES (27)..(33): Variable amino acid
  MOD_RES (35)..(35): Variable amino acid
  MOD_RES (37)..(37): Variable amino acid
  MOD_RES (39)..(41): Variable amino acid
  MOD_RES (43)..(43): Variable amino acid
  MOD_RES (45)..(47): Variable amino acid
  MOD_RES (50)..(50): Variable amino acid
  MOD_RES (51)..(51): Variable amino acid that may or may not be present
  MOD_RES (53)..(55): Variable amino acid that may or may not be present
  MOD_RES (56)..(57): Variable amino acid
  MOD_RES (59)..(59): Variable amino acid
  MOD_RES (65)..(66): Variable amino acid
  MOD_RES (67)..(67): Variable amino acid that may or may not be present
  MOD_RES (69)..(72): Variable amino acid
  MOD_RES (74)..(78): Variable amino acid
  MOD_RES (80)..(81): Variable amino acid
  MOD_RES (82)..(83): Variable amino acid that may or may not be present
  MOD_RES (84)..(84): Variable amino acid
CXXXXXXXXXXXXXXXXXXXXXXXXXXXXXXXXYXPXCXXXGXYXXXQCXXSXXXXXGXCWCVDXXXGXXXXGXXXXXGXXXXXC

SEQ ID NO: 359 - protein, 85 aa, Artificial Sequence
  Description of Artificial Sequence: Synthetic polypeptide
  MOD_RES (2)..(2): Gln, Glu, Arg or Leu
  MOD_RES (3)..(16): Variable amino acid
  MOD_RES (17)..(26): Variable amino acid that may or may not be present
  MOD_RES (27)..(33): Variable amino acid
  MOD_RES (34)..(34): Tyr, Phe, His or Pro
  MOD_RES (35)..(35): Variable amino acid
  MOD_RES (37)..(37): Variable amino acid
  MOD_RES (39)..(41): Variable amino acid
  MOD_RES (43)..(43): Variable amino acid
  MOD_RES (44)..(44): Tyr or Phe
  MOD_RES (45)..(46): Variable amino acid
  MOD_RES (47)..(47): Val, Lys, Arg or Leu
  MOD_RES (50)..(50): Variable amino acid
  MOD_RES (51)..(51): Variable amino acid that may or may not be present
  MOD_RES (52)..(52): Ser, Ala or not present
  MOD_RES (53)..(55): Variable amino acid that may or may not be present
  MOD_RES (56)..(59): Variable amino acid
  MOD_RES (58)..(58): Gly, Ser or Ala
  MOD_RES (59)..(59): Variable amino acid
  MOD_RES (61)..(61): Trp, Tyr or Phe
  MOD_RES (64)..(64): Asp, Asn, Tyr, Phe or Leu
  MOD_RES (65)..(66): Variable amino acid
  MOD_RES (67)..(67): Variable amino acid that may or may not be present
  MOD_RES (69)..(72): Variable amino acid
  MOD_RES (73)..(73): Gly, Asp, Asn or Glu
  MOD_RES (74)..(78): Variable amino acid
  MOD_RES (80)..(81): Variable amino acid
  MOD_RES (82)..(83): Variable amino acid that may or may not be present
  MOD_RES (84)..(84): Variable amino acid
CXXXXXXXXXXXXXXXXXXXXXXXXXXXXXXXXXXPXCXXXGXXXXXQCXXXXXXXXXXCXCVXXXXGXXXXXXXXXXGXXXXXC

SEQ ID NO: 360 - protein, 85 aa, Artificial Sequence; identical to SEQ ID NO: 359
  Description of Artificial Sequence: Synthetic polypeptide
  MOD_RES (2)..(2): Gln, Glu, Arg or Leu
  MOD_RES (3)..(16): Variable amino acid
  MOD_RES (17)..(26): Variable amino acid that may or may not be present
  MOD_RES (27)..(33): Variable amino acid
  MOD_RES (34)..(34): Trp, Tyr, Phe, Leu, His or Pro
  MOD_RES (35)..(35): Variable amino acid
  MOD_RES (37)..(37): Variable amino acid
  MOD_RES (39)..(41): Variable amino acid
  MOD_RES (43)..(43): Variable amino acid
  MOD_RES (44)..(44): Trp, Tyr, Phe or Leu
  MOD_RES (45)..(46): Variable amino acid
  MOD_RES (47)..(47): Val, Lys, Arg or Leu
  MOD_RES (50)..(50): Variable amino acid
  MOD_RES (51)..(51): Variable amino acid that may or may not be present
  MOD_RES (52)..(52): Ser, Ala or not present
  MOD_RES (53)..(55): Variable amino acid that may or may not be present
  MOD_RES (56)..(57): Variable amino acid
  MOD_RES (58)..(58): Gly, Ala or Ser
  MOD_RES (59)..(59): Variable amino acid
  MOD_RES (61)..(61): Trp, Tyr, Phe or Leu
  MOD_RES (64)..(64): Asp, Asn, Trp, Tyr, Phe or Leu
  MOD_RES (65)..(66): Variable amino acid
  MOD_RES (67)..(67): Variable amino acid that may or may not be present
  MOD_RES (69)..(72): Variable amino acid
  MOD_RES (73)..(73): Asp, Glu, Asn or Gly
  MOD_RES (74)..(78): Variable amino acid
  MOD_RES (80)..(84): Variable amino acid
  MOD_RES (82)..(83): Variable amino acid that may or may not be present
  MOD_RES (84)..(84): Variable amino acid

SEQ ID NO: 361 - protein, 61 aa, Artificial Sequence
  Description of Artificial Sequence: Synthetic polypeptide
  MOD_RES (2)..(2): Variable amino acid
  MOD_RES (4)..(9): Variable amino acid
  MOD_RES (10)..(12): Variable amino acid that may or may not be present
  MOD_RES (13)..(14): Variable amino acid
  MOD_RES (16)..(18): Variable amino acid
  MOD_RES (19)..(24): Variable amino acid that may or may not be present
  MOD_RES (25)..(28): Variable amino acid
  MOD_RES (30)..(30): Variable amino acid
  MOD_RES (32)..(39): Variable amino acid
  MOD_RES (41)..(42): Variable amino acid
  MOD_RES (44)..(50): Variable amino acid
  MOD_RES (51)..(55): Variable amino acid that may or may not be present
  MOD_RES (56)..(60): Variable amino acid
CXCXXXXXXXXXXXCXXXXXXXXXXXXXCXCXXXXXXXXCXXCXXXXXXXXXXXXXXXXXC

SEQ ID NO: 362 - protein, 61 aa, Artificial Sequence
  Description of Artificial Sequence: Synthetic polypeptide
  MOD_RES (2)..(2): Variable amino acid
  MOD_RES (4)..(9): Variable amino acid
  MOD_RES (10)..(12): Variable amino acid that may or may not be present
  MOD_RES (13)..(14): Variable amino acid
  MOD_RES (16)..(18): Variable amino acid
  MOD_RES (19)..(24): Variable amino acid that may or may not be present
  MOD_RES (25)..(26): Variable amino acid
  MOD_RES (28)..(28): Variable amino acid
  MOD_RES (30)..(30): Variable amino acid
  MOD_RES (32)..(36): Variable amino acid
  MOD_RES (38)..(39): Variable amino acid
  MOD_RES (41)..(42): Variable amino acid
  MOD_RES (44)..(50): Variable amino acid
  MOD_RES (51)..(55): Variable amino acid that may or may not be present
  MOD_RES (56)..(60): Variable amino acid
CXCXXXXXXXXXXXCXXXXXXXXXXXGXCXCXXXXXGXXCXXCXXXXXXXXXXXXXXXXXC

SEQ ID NO: 363 - protein, 61 aa, Artificial Sequence; identical to SEQ ID NO: 362
  Description of Artificial Sequence: Synthetic polypeptide
  MOD_RES (2)..(2): Variable amino acid
  MOD_RES (4)..(4): Asn, Asp or His
  MOD_RES (5)..(9): Variable amino acid
  MOD_RES (10)..(12): Variable amino acid that may or may not be present
  MOD_RES (13)..(14): Variable amino acid
  MOD_RES (16)..(18): Variable amino acid
  MOD_RES (19)..(24): Variable amino acid that may or may not be present
  MOD_RES (25)..(26): Variable amino acid
  MOD_RES (28)..(28): Variable amino acid
  MOD_RES (30)..(30): Variable amino acid
  MOD_RES (32)..(36): Variable amino acid
  MOD_RES (38)..(39): Variable amino acid
  MOD_RES (41)..(41): Asp, Glu, Asn or Gln
  MOD_RES (42)..(42): Variable amino acid
  MOD_RES (44)..(45): Variable amino acid
  MOD_RES (46)..(46): Gly or Asn
  MOD_RES (47)..(47): Tyr, Phe, His or Thr
  MOD_RES (48)..(50): Variable amino acid
  MOD_RES (51)..(55): Variable amino acid that may or may not be present
  MOD_RES (56)..(60): Variable amino acid

SEQ ID NO: 364 - protein, 57 aa, Artificial Sequence
  Description of Artificial Sequence: Synthetic polypeptide
  MOD_RES (2)..(2): Variable amino acid
  MOD_RES (6)..(7): Variable amino acid
  MOD_RES (8)..(9): Variable amino acid that may or may not be present
  MOD_RES (10)..(13): Variable amino acid
  MOD_RES (15)..(15): Variable amino acid
  MOD_RES (16)..(17): Variable amino acid that may or may not be present
  MOD_RES (18)..(22): Variable amino acid
  MOD_RES (24)..(24): Variable amino acid
  MOD_RES (26)..(27): Variable amino acid
  MOD_RES (29)..(29): Variable amino acid
  MOD_RES (31)..(31): Variable amino acid
  MOD_RES (33)..(33): Variable amino acid
  MOD_RES (34)..(36): Variable amino acid that may or may not be present
  MOD_RES (37)..(37): Variable amino acid
  MOD_RES (39)..(40): Variable amino acid
  MOD_RES (42)..(48): Variable amino acid
  MOD_RES (49)..(53): Variable amino acid that may or may not be present
  MOD_RES (54)..(56): Variable amino acid
DXDECXXXXXXXXCXXXXXXXXCXNXXGXFXCXXXXXCXXGXXXXXXXXXXXXXXXC

SEQ ID NO: 365 - protein, 34 aa, Artificial Sequence
  Description of Artificial Sequence: Synthetic polypeptide
  MOD_RES (2)..(3): Variable amino acid
  MOD_RES (4)..(5): Variable amino acid that may or may not be present
  MOD_RES (6)..(8): Variable amino acid
  MOD_RES (10)..(14): Variable amino acid
  MOD_RES (17)..(17): Variable amino acid
  MOD_RES (19)..(21): Variable amino acid
  MOD_RES (24)..(26): Variable amino acid
  MOD_RES (28)..(29): Variable amino acid
  MOD_RES (32)..(32): Variable amino acid
CXXXXXXXCXXXXXNGXCXXXCNXXXCXXDGXDC

SEQ ID NO: 366 - protein, 43 aa, Artificial Sequence
  Description of Artificial Sequence: Synthetic polypeptide
  MOD_RES (2)..(4): Variable amino acid
  MOD_RES (8)..(9): Variable amino acid
  MOD_RES (11)..(12): Variable amino acid
  MOD_RES (15)..(18): Variable amino acid
  MOD_RES (20)..(22): Variable amino acid
  MOD_RES (24)..(25): Variable amino acid
  MOD_RES (27)..(29): Variable amino acid
  MOD_RES (31)..(33): Variable amino acid
  MOD_RES (35)..(36): Variable amino acid
  MOD_RES (39)..(39): Variable amino acid
  MOD_RES (41)..(42): Variable amino acid
CXXXYYGXXCXXFCXXXXDXXXHXXCXXXGXXXCXXGWXGXXC

SEQ ID NO: 367 - protein, 38 aa, Artificial Sequence
  Description of Artificial Sequence: Synthetic polypeptide
  MOD_RES (3)..(3): Variable amino acid
  MOD_RES (6)..(10): Variable amino acid
  MOD_RES (11)..(11): Variable amino acid that may or may not be present
  MOD_RES (12)..(15): Variable amino acid
  MOD_RES (18)..(18): Variable amino acid
  MOD_RES (20)..(25): Variable amino acid
  MOD_RES (26)..(27): Variable amino acid that may or may not be present
  MOD_RES (28)..(29): Variable amino acid
  MOD_RES (31)..(33): Variable amino acid
  MOD_RES (35)..(36): Variable amino acid
CCXDGXXXXXXXXXXCEXRXXXXXXXXXXCXXXFXXCC

SEQ ID NO: 368 - protein, 41 aa, Artificial Sequence
  Description of Artificial Sequence: Synthetic polypeptide
  MOD_RES (2)..(3): Variable amino acid
  MOD_RES (5)..(8): Variable amino acid
  MOD_RES (10)..(10): Variable amino acid
  MOD_RES (12)..(12): Variable amino acid
  MOD_RES (15)..(18): Variable amino acid
  MOD_RES (20)..(22): Variable amino acid
  MOD_RES (23)..(23): May or may not be present
  MOD_RES (24)..(24): Variable amino acid that may or may not be present
  MOD_RES (25)..(28): Variable amino acid
  MOD_RES (32)..(35): Variable amino acid
  MOD_RES (37)..(39): Variable amino acid
CXXCXXXXPXCXWCXXXXFXXXGXXXXXRCDXXXXLXXXGC

SEQ ID NO: 369 - protein, 57 aa, Artificial Sequence
  Description of Artificial Sequence: Synthetic polypeptide
  MOD_RES (2)..(2): Val, Ile, Leu, Ala, Met or Phe
  MOD_RES (3)..(3): Asp or Asn
  MOD_RES (6)..(7): Variable amino acid
  MOD_RES (8)..(9): Variable amino acid that may or may not be present
  MOD_RES (10)..(13): Variable amino acid
  MOD_RES (15)..(15): Pro, Asp or Gly
  MOD_RES (16)..(16): May or may not be present
  MOD_RES (17)..(17): Variable amino acid that may or may not be present
  MOD_RES (18)..(22): Variable amino acid
  MOD_RES (24)..(24): Variable amino acid
  MOD_RES (26)..(27): Variable amino acid
  MOD_RES (29)..(29): Ser, Gly or Thr
  MOD_RES (30)..(30): Trp, Tyr, Phe or Leu
  MOD_RES (31)..(31): Variable amino acid
  MOD_RES (33)..(33): Variable amino acid
  MOD_RES (34)..(36): Variable amino acid that may or may not be present
  MOD_RES (37)..(37): Variable amino acid
  MOD_RES (39)..(40): Variable amino acid
  MOD_RES (41)..(41): Gln, Ser or Asn
  MOD_RES (42)..(42): Trp, Tyr, Phe, Leu or Ser
  MOD_RES (43)..(48): Variable amino acid
  MOD_RES (49)..(53): Variable amino acid that may or may not be present
  MOD_RES (54)..(56): Variable amino acid
DXXECXXXXXXXXCXDXXXXXXCXNXXGXXXCXXXXXCXXXXXXXXXXXXXXXXXXC

SEQ ID NO: 370 - protein, 34 aa, Artificial Sequence
  Description of Artificial Sequence: Synthetic polypeptide
  MOD_RES (2)..(3): Variable amino acid
  MOD_RES (4)..(4): Variable amino acid that may or may not be present
  MOD_RES (5)..(5): Val, Ile, Leu, Ala, Met, Phe, Trp, Tyr or not present
  MOD_RES (6)..(8): Variable amino acid
  MOD_RES (10)..(10): Variable amino acid
  MOD_RES (11)..(11): Asp, Glu, Asn or Ser
  MOD_RES (12)..(14): Variable amino acid
  MOD_RES (15)..(15): Asp, Glu or Asn
  MOD_RES (16)..(16): Gly or Lys
  MOD_RES (17)..(17): Variable amino acid
  MOD_RES (19)..(19): Asn or Asp
  MOD_RES (20)..(20): Variable amino acid
  MOD_RES (21)..(21): Asp, Glu, Asn, Ser or Ala
  MOD_RES (23)..(23): Asp, Glu, Asn or Ser
  MOD_RES (24)..(25): Variable amino acid
  MOD_RES (26)..(26): Ala, Glu or Gly
  MOD_RES (28)..(28): Variable amino acid
  MOD_RES (29)..(29): Trp, Tyr, Phe or Leu
  MOD_RES (32)..(32): Variable amino acid
CXXXXXXXCXXXXXXXXCXXXCXXXXCXXDGXDC

SEQ ID NO: 371 - protein, 43 aa, Artificial Sequence
  Description of Artificial Sequence: Synthetic polypeptide
  MOD_RES (2)..(4): Variable amino acid
  MOD_RES (5)..(5): Trp, Tyr, Phe or Leu
  MOD_RES (6)..(6): Trp, Tyr, Phe, Leu or His
  MOD_RES (7)..(7): Gly, Ser, Asn or Ala
  MOD_RES (8)..(9): Variable amino acid
  MOD_RES (11)..(12): Variable amino acid
  MOD_RES (13)..(13): Trp, Tyr, Phe or Leu
  MOD_RES (15)..(15): Variable amino acid
  MOD_RES (16)..(16): Pro, Ala or Glu
  MOD_RES (17)..(18): Variable amino acid
  MOD_RES (19)..(19): Asp or Ala
  MOD_RES (20)..(21): Variable amino acid
  MOD_RES (22)..(22): Gly, Ala, Ser, Thr or Leu
  MOD_RES (23)..(23): His, Arg, Gly or Lys
  MOD_RES (24)..(24): Trp, Tyr, Phe, Leu or Lys
  MOD_RES (25)..(25): Variable amino acid
  MOD_RES (27)..(27): Asp, Asn, Ser or Gly
  MOD_RES (28)..(29): Variable amino acid
  MOD_RES (31)..(33): Variable amino acid
  MOD_RES (35)..(36): Variable amino acid
  MOD_RES (38)..(38): Trp, Tyr, Phe or Leu
  MOD_RES (39)..(39): Variable amino acid
  MOD_RES (41)..(42): Variable amino acid
CXXXXXXXXCXXXCXXXXXXXXXXXCXXXGXXXCXXGXXGXXC

SEQ ID NO: 372 - protein, 39 aa, Artificial Sequence
  Description of Artificial Sequence: Synthetic polypeptide
  MOD_RES (3)..(3): Variable amino acid
  MOD_RES (4)..(4): Asp, His, Thr or Leu
  MOD_RES (5)..(5): Gly or Ala
  MOD_RES (6)..(9): Variable amino acid
  MOD_RES (10)..(10): Pro, Leu, Ala, Asn or Thr
  MOD_RES (11)..(12): Variable amino acid that may or may not be present
  MOD_RES (13)..(16): Variable amino acid
  MOD_RES (18)..(18): Glu, Ser, Gln, Asp, Ala or Thr
  MOD_RES (19)..(19): Variable amino acid
  MOD_RES (20)..(20): Arg, Leu, Pro or Ser
  MOD_RES (21)..(26): Variable amino acid
  MOD_RES (27)..(27): Gly, Glu, Pro, Ala or not present
  MOD_RES (28)..(28): Variable amino acid that may or may not be present
  MOD_RES (29)..(30): Variable amino acid
  MOD_RES (32)..(33): Variable amino acid
  MOD_RES (34)..(34): Ala, Val, Phe, Pro or Thr
  MOD_RES (35)..(35): Phe, Gln, Val or Tyr
  MOD_RES (36)..(37): Variable amino acid
CCXXXXXXXXXXXXXXCXXXXXXXXXXXXXCXXXXXXCC

SEQ ID NO: 373 - protein, 41 aa, Artificial Sequence
  Description of Artificial Sequence: Synthetic polypeptide
  MOD_RES (2)..(3): Variable amino acid
  MOD_RES (5)..(5): Val, Ile, Leu, Ala, Met or Phe
  MOD_RES (6)..(7): Variable amino acid
  MOD_RES (8)..(8): Gly, His, Asp or Ser
  MOD_RES (9)..(9): Pro or Lys
  MOD_RES (10)..(10): Variable amino acid
  MOD_RES (12)..(12): Gly, Ala, Ser or Thr
  MOD_RES (13)..(13): Trp, Tyr, Phe or Leu
  MOD_RES (15)..(18): Variable amino acid
  MOD_RES (19)..(19): Trp, Tyr, Phe or Leu
  MOD_RES (20)..(22): Variable amino acid
  MOD_RES (23)..(23): Gly, Arg or not present
  MOD_RES (24)..(25): Variable amino acid that may or may not be present
  MOD_RES (26)..(26): Variable amino acid
  MOD_RES (27)..(27): Gly, Ala, Ser or Thr
  MOD_RES (28)..(28): Variable amino acid
  MOD_RES (31)..(31): Asp, Asn, Ala or Glu
  MOD_RES (32)..(35): Variable amino acid
  MOD_RES (37)..(37): Val, Ile, Leu, Ala, Met, Phe or Lys
  MOD_RES (38)..(39): Variable amino acid
  MOD_RES (40)..(40): Gly or Asn
CXXCXXXXXXCXXCXXXXXXXXXXXXXXRCXXXXXLXXXXC

SEQ ID NO: 374 - protein, 57 aa, Artificial Sequence; identical to SEQ ID NO: 369
  Description of Artificial Sequence: Synthetic polypeptide
  MOD_RES (2)..(2): Val, Ile, Leu or Phe
  MOD_RES (3)..(3): Asp or Asn
  MOD_RES (6)..(7): Variable amino acid
  MOD_RES (8)..(9): Variable amino acid that may or may not be present
  MOD_RES (10)..(13): Variable amino acid
  MOD_RES (15)..(15): Pro, Asp or Gly
  MOD_RES (16)..(16): May or may not be present
  MOD_RES (17)..(17): Variable amino acid that may or may not be present
  MOD_RES (18)..(22): Variable amino acid
  MOD_RES (24)..(24): Variable amino acid
  MOD_RES (26)..(27): Variable amino acid
  MOD_RES (29)..(29): Ser, Gly or Thr
  MOD_RES (30)..(30): Phe or Tyr
  MOD_RES (31)..(31): Variable amino acid
  MOD_RES (33)..(33): Variable amino acid
  MOD_RES (34)..(36): Variable amino acid that may or may not be present
  MOD_RES (37)..(37): Variable amino acid
  MOD_RES (39)..(40): Variable amino acid
  MOD_RES (41)..(41): Gly, Ser or Asn
  MOD_RES (42)..(42): Trp, Tyr, Phe, Leu or Ser
  MOD_RES (43)..(48): Variable amino acid
  MOD_RES (49)..(53): Variable amino acid that may or may not be present
  MOD_RES (54)..(56): Variable amino acid

SEQ ID NO: 375 - protein, 34 aa, Artificial Sequence; identical to SEQ ID NO: 370
  Description of Artificial Sequence: Synthetic polypeptide
  MOD_RES (2)..(3): Variable amino acid
  MOD_RES (4)..(4): Variable amino acid that may or may not be present
  MOD_RES (5)..(5): Tyr, Ile, Phe, Leu, Val or not present
  MOD_RES (6)..(8): Variable amino acid
  MOD_RES (10)..(10): Variable amino acid
  MOD_RES (11)..(11): Asp, Glu, Asn or Ser
  MOD_RES (12)..(14): Variable amino acid
  MOD_RES (15)..(15): Asn, Asp or Glu
  MOD_RES (16)..(16): Gly or Lys
  MOD_RES (17)..(17): Variable amino acid
  MOD_RES (19)..(19): Asn or Asp
  MOD_RES (20)..(20): Variable amino acid
  MOD_RES (21)..(21): Asp, Glu, Asn, Ser or Ala
  MOD_RES (23)..(23): Asn, Ser, Asp or Glu
  MOD_RES (24)..(25): Variable amino acid
  MOD_RES (26)..(26): Ala, Glu or Gly
  MOD_RES (28)..(28): Variable amino acid
  MOD_RES (29)..(29): Trp, Tyr or Phe
  MOD_RES (32)..(32): Variable amino acid

SEQ ID NO: 376 - protein, 43 aa, Artificial Sequence; identical to SEQ ID NO: 371
  Description of Artificial Sequence: Synthetic polypeptide
  MOD_RES (2)..(4): Variable amino acid
  MOD_RES (5)..(5): Tyr, Trp or Phe
  MOD_RES (6)..(6): Tyr, Phe or His
  MOD_RES (7)..(7): Gly, Ala, Ser or Asn
  MOD_RES (8)..(9): Variable amino acid
  MOD_RES (11)..(12): Variable amino acid
  MOD_RES (13)..(13): Phe or Tyr
  MOD_RES (15)..(15): Variable amino acid
  MOD_RES (16)..(16): Pro, Ala or Glu
  MOD_RES (17)..(18): Variable amino acid
  MOD_RES (19)..(19): Asp or Ala
  MOD_RES (20)..(21): Variable amino acid
  MOD_RES (22)..(22): Gly, Leu, Ala, Ser or Thr
  MOD_RES (23)..(23): His, Arg, Gly or Lys
  MOD_RES (24)..(24): Tyr, Lys, Phe or Trp
  MOD_RES (25)..(25): Variable amino acid
  MOD_RES (27)..(27): Asp, Ser, Gly or Asn
  MOD_RES (28)..(29): Variable amino acid
  MOD_RES (31)..(33): Variable amino acid
  MOD_RES (35)..(36): Variable amino acid
  MOD_RES (38)..(38): Trp, Leu, Phe or Tyr
  MOD_RES (39)..(39): Variable amino acid
  MOD_RES (41)..(42): Variable amino acid

SEQ ID NO: 377 - protein, 38 aa, Artificial Sequence
  Description of Artificial Sequence: Synthetic polypeptide
  MOD_RES (3)..(3): Variable amino acid
  MOD_RES (4)..(4): Ala, Asp, Glu, His, Leu or Thr
  MOD_RES (6)..(13): Variable amino acid
  MOD_RES (14)..(14): Variable amino acid that may or may not be present
  MOD_RES (15)..(15): Asp, Glu, Arg, Ser or Thr
  MOD_RES (17)..(25): Variable amino acid
  MOD_RES (26)..(27): Variable amino acid that may or may not be present
  MOD_RES (28)..(28): Ala, Glu, Arg, Ser, Val or not present
  MOD_RES (30)..(31): Variable amino acid
  MOD_RES (32)..(32): Ala, Pro, Val or Thr
  MOD_RES (33)..(33): Phe, Met or Gln
  MOD_RES (34)..(34): Glu, Lys, Leu, Gln, Arg, Thr or Val
  MOD_RES (35)..(35): Ala, Asp, Glu, His, Gln, Arg, Ser or Lys
  MOD_RES (36)..(36): Variable amino acid that may or may not be present
CCXXGXXXXXXXXXXCXXXXXXXXXXXXCXXXXXXXCC

SEQ ID NO: 378 - protein, 41 aa, Artificial Sequence; identical to SEQ ID NO: 373
  Description of Artificial Sequence: Synthetic polypeptide
  MOD_RES (2)..(2): Ala, Glu, Gly, Lys, Gln, Arg, Ser or Thr
  MOD_RES (3)..(3): Lys, Arg, Glu, Gln or Asp
  MOD_RES (5)..(5): Ile or Leu
  MOD_RES (6)..(6): Ala, Glu, Leu, Gln, Arg or Val
  MOD_RES (7)..(7): Val, Ile, Leu, Ala or Ser
  MOD_RES (8)..(8): Asp, Gly, His or Ser
  MOD_RES (9)..(9): Lys or Pro
  MOD_RES (10)..(10): Variable amino acid
  MOD_RES (12)..(12): Gly, Ala, Ser or Thr
  MOD_RES (13)..(13): Trp or Tyr
  MOD_RES (15)..(18): Variable amino acid
  MOD_RES (19)..(19): Phe or Leu
  MOD_RES (20)..(23): Variable amino acid
  MOD_RES (24)..(27): Variable amino acid that may or may not be present
  MOD_RES (28)..(28): Val, Ile, Leu, Ala, Arg or not present
  MOD_RES (29)..(29): May or may not be present
  MOD_RES (31)..(31): Ala, Asn or Asp
  MOD_RES (32)..(32): Asp, Ile, Leu, Arg or Thr
  MOD_RES (33)..(33): Ile, Lys, Leu, Pro, Gln, Arg or Val
  MOD_RES (34)..(34): Ala, Asp, Glu, Pro or Ser
  MOD_RES (35)..(35): Ala, Glu, Asn or Gln
  MOD_RES (37)..(37): Ile, Lys, Leu, Gln or Val
  MOD_RES (38)..(38): Variable amino acid
  MOD_RES (39)..(39): Ala, Asp, Lys, Asn or Arg
  MOD_RES (40)..(40): Gly or Asn

SEQ ID NO: 379 - protein, 6 aa, Artificial Sequence
  Description of Artificial Sequence: Synthetic 6xHis tag
HHHHHH

SEQ ID NO: 380 - DNA, 63 bp, Artificial Sequence
  Description of Artificial Sequence: Synthetic oligonucleotide
agcttataacttcgtatagaaaggtatatacgaagttatagatctcgtgctgcatgcggtgcg

SEQ ID NO: 381 - DNA, 67 bp, Artificial Sequence
  Description of Artificial Sequence: Synthetic oligonucleotide
aattcgcaccgcatgcagcacgagatctataacttcgtatatacctttctatacgaagttataagct

SEQ ID NO: 382 - DNA, 38 bp, Artificial Sequence
  Description of Artificial Sequence: Synthetic oligonucleotide
ataacttcgtatagcatacattatacgaagttatcgag

SEQ ID NO: 383 - DNA, 39 bp, Artificial Sequence
  Description of Artificial Sequence: Synthetic oligonucleotide
ctcgataacttcgtataatgtatgctatacgaagttatg

SEQ ID NO: 384 - DNA, 79 bp, Artificial Sequence
  Description of Artificial Sequence: Synthetic oligonucleotide
ccgggagcagggcatgctaagtgagtaataagtgagtaaataacttcgtatatacctttctatacgaagttatcgtctg

SEQ ID NO: 385 - DNA, 72 bp, Artificial Sequence
  Description of Artificial Sequence: Synthetic oligonucleotide
acgataacttcgtatagaaaggtatatacgaagttatttactcacttattactcacttagcatgccctgctc

SEQ ID NO: 386 - DNA, 59 bp, Artificial Sequence
  Description of Artificial Sequence: Synthetic oligonucleotide
ccgggaccagtggcctctggggccataacttcgtatagcatacattatacgaagttatg

SEQ ID NO: 387 - DNA, 55 bp, Artificial Sequence
  Description of Artificial Sequence: Synthetic oligonucleotide
cataacttcgtataatgtatgctatacgaagttatggccccagaggccactggtc

SEQ ID NO: 388 - DNA, 30 bp, Artificial Sequence
  Description of Artificial Sequence: Synthetic oligonucleotide
atggcgaattctcattgtcggcgcaactat

SEQ ID NO: 389 - DNA, 33 bp, Artificial Sequence
  Description of Artificial Sequence: Synthetic oligonucleotide
gataagctttcattaagactccttattacgcag

SEQ ID NO: 390 - protein, 43 aa, Artificial Sequence
  Description of Artificial Sequence: Synthetic polypeptide
  MOD_RES (1)..(5): Variable amino acid
  MOD_RES (7)..(12): Variable amino acid and this region may encompass 4 to 6 residues
  MOD_RES (14)..(18): Variable amino acid and this region may encompass 4 or 5 residues
  MOD_RES (20)..(27): Variable amino acid
  MOD_RES (29)..(29): Variable amino acid
  MOD_RES (31)..(42): Variable amino acid and this region may encompass 8 to 12 residues
XXXXXCXXXXXXCXXXXXCXXXXXXXXCXCXXXXXXXXXXXXC

SEQ ID NO: 391 - protein, 36 aa, Artificial Sequence
  Description of Artificial Sequence: Synthetic polypeptide
  MOD_RES (1)..(1): Val, Thr or Ile
  MOD_RES (3)..(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (17)...(17): Val, Gln or Leu
  MOD_RES (19)...(19): Thr, Ser or Leu
  MOD_RES (20)...(20): Val, Gln or Pro
  MOD_RES (22)...(22): Ser or Gly
  MOD_RES (23)...(23): Thr or Phe
  MOD_RES (24)...(24): Ser, Arg or Gln
  MOD_RES (26)...(26): Val, Ser or Arg
  MOD_RES (28)...(28): Val, Pro or Leu
  MOD_RES (29)...(29): Gln, Pro or Glu
  MOD_RES (31)...(31): Tyr or Phe
  MOD_RES (32)...(32): Thr, Ser or Ala
  MOD_RES (33)...(33): Gly, Leu or Pro
  MOD_RES (34)...(34): Val, Thr or Gln
  MOD_RES (35)...(35): Ser, Arg or Asn
XDXBECXXXXCXXXXCXBXXGXXXCXCXXGXXXXXC

SEQ ID NO: 392 - protein, 37 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
XDXBECXXXXXCXXXXCXBXXGXXXCXCXXGXXXXXC

SEQ ID NO: 393 - protein, 38 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
XDXBECXXXXXXCXXXXCXBXXGXXXCXCXXGXXXXXC

SEQ ID NO: 394 - protein, 37 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (16)...(16): Ile or Lys
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
XDXBECXXXXCXXXXXCXBXXGXXXCXCXXGXXXXXC

SEQ ID NO: 395 - protein, 38 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (17)...(17): Ile or Lys
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
XDXBECXXXXXCXXXXXCXBXXGXXXCXCXXGXXXXXC

SEQ ID NO: 396 - protein, 39 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (18)...(18): Ile or Lys
  MOD_RES (20)...(20): Val, Gln or Leu
  MOD_RES (22)...(22): Thr, Ser or Leu
  MOD_RES (23)...(23): Val, Gln or Pro
  MOD_RES (25)...(25): Ser or Gly
  MOD_RES (26)...(26): Thr or Phe
  MOD_RES (27)...(27): Ser, Arg or Gln
  MOD_RES (29)...(29): Val, Ser or Arg
  MOD_RES (31)...(31): Val, Pro or Leu
  MOD_RES (32)...(32): Gln, Pro or Glu
  MOD_RES (34)...(34): Tyr or Phe
  MOD_RES (35)...(35): Thr, Ser or Ala
  MOD_RES (36)...(36): Gly, Leu or Pro
  MOD_RES (37)...(37): Val, Thr or Gln
  MOD_RES (38)...(38): Ser, Arg or Asn
XDXBECXXXXXXCXXXXXCXBXXGXXXCXCXXGXXXXXC

SEQ ID NO: 397 - protein, 37 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (17)...(17): Val, Gln or Leu
  MOD_RES (19)...(19): Thr, Ser or Leu
  MOD_RES (20)...(20): Val, Gln or Pro
  MOD_RES (22)...(22): Ser or Gly
  MOD_RES (23)...(23): Thr or Phe
  MOD_RES (24)...(24): Ser, Arg or Gln
  MOD_RES (26)...(26): Val, Ser or Arg
  MOD_RES (28)...(28): Val, Pro or Leu
  MOD_RES (29)...(29): Gln, Pro or Glu
  MOD_RES (31)...(31): Tyr or Phe
  MOD_RES (32)...(32): Thr, Ser or Ala
  MOD_RES (33)...(33): Gly, Leu or Pro
  MOD_RES (34)...(34): Val, Thr or Gln
  MOD_RES (35)...(35): Ser, Arg or Asn
  MOD_RES (36)...(36): Ala or Asp
XDXBECXXXXCXXXXCXBXXGXXXCXCXXGXXXXXXC

SEQ ID NO: 398 - protein, 38 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
XDXBECXXXXXCXXXXCXBXXGXXXCXCXXGXXXXXXC

SEQ ID NO: 399 - protein, 39 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
XDXBECXXXXXXCXXXXCXBXXGXXXCXCXXGXXXXXXC

SEQ ID NO: 400 - protein, 38 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (16)...(16): Ile or Lys
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
XDXBECXXXXCXXXXXCXBXXGXXXCXCXXGXXXXXXC

SEQ ID NO: 401 - protein, 39 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (17)...(17): Ile or Lys
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
XDXBECXXXXXCXXXXXCXBXXGXXXCXCXXGXXXXXXC

SEQ ID NO: 402 - protein, 40 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (18)...(18): Ile or Lys
  MOD_RES (20)...(20): Val, Gln or Leu
  MOD_RES (22)...(22): Thr, Ser or Leu
  MOD_RES (23)...(23): Val, Gln or Pro
  MOD_RES (25)...(25): Ser or Gly
  MOD_RES (26)...(26): Thr or Phe
  MOD_RES (27)...(27): Ser, Arg or Gln
  MOD_RES (29)...(29): Val, Ser or Arg
  MOD_RES (31)...(31): Val, Pro or Leu
  MOD_RES (32)...(32): Gln, Pro or Glu
  MOD_RES (34)...(34): Tyr or Phe
  MOD_RES (35)...(35): Thr, Ser or Ala
  MOD_RES (36)...(36): Gly, Leu or Pro
  MOD_RES (37)...(37): Val, Thr or Gln
  MOD_RES (38)...(38): Ser, Arg or Asn
  MOD_RES (39)...(39): Ala or Asp
XDXBECXXXXXXCXXXXXCXBXXGXXXCXCXXGXXXXXXC

SEQ ID NO: 403 - protein, 38 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (17)...(17): Val, Gln or Leu
  MOD_RES (19)...(19): Thr, Ser or Leu
  MOD_RES (20)...(20): Val, Gln or Pro
  MOD_RES (22)...(22): Ser or Gly
  MOD_RES (23)...(23): Thr or Phe
  MOD_RES (24)...(24): Ser, Arg or Gln
  MOD_RES (26)...(26): Val, Ser or Arg
  MOD_RES (28)...(28): Val, Pro or Leu
  MOD_RES (29)...(29): Gln, Pro or Glu
  MOD_RES (31)...(31): Tyr or Phe
  MOD_RES (32)...(32): Thr, Ser or Ala
  MOD_RES (33)...(33): Gly, Leu or Pro
  MOD_RES (34)...(34): Val, Thr or Gln
  MOD_RES (35)...(35): Ser, Arg or Asn
  MOD_RES (36)...(36): Ala or Asp
  MOD_RES (37)...(37): Gly or Arg
XDXBECXXXXCXXXXCXBXXGXXXCXCXXGXXXXXXXC

SEQ ID NO: 404 - protein, 39 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
  MOD_RES (38)...(38): Gly or Arg
XDXBECXXXXXCXXXXCXBXXGXXXCXCXXGXXXXXXXC

SEQ ID NO: 405 - protein, 40 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
  MOD_RES (39)...(39): Gly or Arg
XDXBECXXXXXXCXXXXCXBXXGXXXCXCXXGXXXXXXXC

SEQ ID NO: 406 - protein, 39 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (16)...(16): Ile or Lys
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
  MOD_RES (38)...(38): Gly or Arg
XDXBECXXXXCXXXXXCXBXXGXXXCXCXXGXXXXXXXC

SEQ ID NO: 407 - protein, 40 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (17)...(17): Ile or Lys
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
  MOD_RES (39)...(39): Gly or Arg
XDXBECXXXXXCXXXXXCXBXXGXXXCXCXXGXXXXXXXC

SEQ ID NO: 408 - protein, 41 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (18)...(18): Ile or Lys
  MOD_RES (20)...(20): Val, Gln or Leu
  MOD_RES (22)...(22): Thr, Ser or Leu
  MOD_RES (23)...(23): Val, Gln or Pro
  MOD_RES (25)...(25): Ser or Gly
  MOD_RES (26)...(26): Thr or Phe
  MOD_RES (27)...(27): Ser, Arg or Gln
  MOD_RES (29)...(29): Val, Ser or Arg
  MOD_RES (31)...(31): Val, Pro or Leu
  MOD_RES (32)...(32): Gln, Pro or Glu
  MOD_RES (34)...(34): Tyr or Phe
  MOD_RES (35)...(35): Thr, Ser or Ala
  MOD_RES (36)...(36): Gly, Leu or Pro
  MOD_RES (37)...(37): Val, Thr or Gln
  MOD_RES (38)...(38): Ser, Arg or Asn
  MOD_RES (39)...(39): Ala or Asp
  MOD_RES (40)...(40): Gly or Arg
XDXBECXXXXXXCXXXXXCXBXXGXXXCXCXXGXXXXXXXC

SEQ ID NO: 409 - protein, 39 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (17)...(17): Val, Gln or Leu
  MOD_RES (19)...(19): Thr, Ser or Leu
  MOD_RES (20)...(20): Val, Gln or Pro
  MOD_RES (22)...(22): Ser or Gly
  MOD_RES (23)...(23): Thr or Phe
  MOD_RES (24)...(24): Ser, Arg or Gln
  MOD_RES (26)...(26): Val, Ser or Arg
  MOD_RES (28)...(28): Val, Pro or Leu
  MOD_RES (29)...(29): Gln, Pro or Glu
  MOD_RES (31)...(31): Tyr or Phe
  MOD_RES (32)...(32): Thr, Ser or Ala
  MOD_RES (33)...(33): Gly, Leu or Pro
  MOD_RES (34)...(34): Val, Thr or Gln
  MOD_RES (35)...(35): Ser, Arg or Asn
  MOD_RES (36)...(36): Ala or Asp
  MOD_RES (37)...(37): Gly or Arg
  MOD_RES (38)...(38): Lys or Asn
XDXBECXXXXCXXXXCXBXXGXXXCXCXXGXXXXXXXXC

SEQ ID NO: 410 - protein, 40 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
  MOD_RES (38)...(38): Gly or Arg
  MOD_RES (39)...(39): Lys or Asn
XDXBECXXXXXCXXXXCXBXXGXXXCXCXXGXXXXXXXXC

SEQ ID NO: 411 - protein, 41 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
  MOD_RES (39)...(39): Gly or Arg
  MOD_RES (40)...(40): Lys or Asn
XDXBECXXXXXXCXXXXCXBXXGXXXCXCXXGXXXXXXXXC

SEQ ID NO: 412 - protein, 40 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (16)...(16): Ile or Lys
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
  MOD_RES (38)...(38): Gly or Arg
  MOD_RES (39)...(39): Lys or Asn
XDXBECXXXXCXXXXXCXBXXGXXXCXCXXGXXXXXXXXC

SEQ ID NO: 413 - protein, 41 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (17)...(17): Ile or Lys
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
  MOD_RES (39)...(39): Gly or Arg
  MOD_RES (40)...(40): Lys or Asn
XDXBECXXXXXCXXXXXCXBXXGXXXCXCXXGXXXXXXXXC

SEQ ID NO: 414 - protein, 42 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (18)...(18): Ile or Lys
  MOD_RES (20)...(20): Val, Gln or Leu
  MOD_RES (22)...(22): Thr, Ser or Leu
  MOD_RES (23)...(23): Val, Gln or Pro
  MOD_RES (25)...(25): Ser or Gly
  MOD_RES (26)...(26): Thr or Phe
  MOD_RES (27)...(27): Ser, Arg or Gln
  MOD_RES (29)...(29): Val, Ser or Arg
  MOD_RES (31)...(31): Val, Pro or Leu
  MOD_RES (32)...(32): Gln, Pro or Glu
  MOD_RES (34)...(34): Tyr or Phe
  MOD_RES (35)...(35): Thr, Ser or Ala
  MOD_RES (36)...(36): Gly, Leu or Pro
  MOD_RES (37)...(37): Val, Thr or Gln
  MOD_RES (38)...(38): Ser, Arg or Asn
  MOD_RES (39)...(39): Ala or Asp
  MOD_RES (40)...(40): Gly or Arg
  MOD_RES (41)...(41): Lys or Asn
XDXBECXXXXXXCXXXXXCXBXXGXXXCXCXXGXXXXXXXXC

SEQ ID NO: 415 - protein, 40 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (17)...(17): Val, Gln or Leu
  MOD_RES (19)...(19): Thr, Ser or Leu
  MOD_RES (20)...(20): Val, Gln or Pro
  MOD_RES (22)...(22): Ser or Gly
  MOD_RES (23)...(23): Thr or Phe
  MOD_RES (24)...(24): Ser, Arg or Gln
  MOD_RES (26)...(26): Val, Ser or Arg
  MOD_RES (28)...(28): Val, Pro or Leu
  MOD_RES (29)...(29): Gln, Pro or Glu
  MOD_RES (31)...(31): Tyr or Phe
  MOD_RES (32)...(32): Thr, Ser or Ala
  MOD_RES (33)...(33): Gly, Leu or Pro
  MOD_RES (34)...(34): Val, Thr or Gln
  MOD_RES (35)...(35): Ser, Arg or Asn
  MOD_RES (36)...(36): Ala or Asp
  MOD_RES (37)...(37): Gly or Arg
  MOD_RES (38)...(38): Lys or Asn
  MOD_RES (39)...(39): Ala or Asp
XDXBECXXXXCXXXXCXBXXGXXXCXCXXGXXXXXXXXXC

SEQ ID NO: 416 - protein, 41 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
  MOD_RES (38)...(38): Gly or Arg
  MOD_RES (39)...(39): Lys or Asn
  MOD_RES (40)...(40): Ala or Asp
XDXBECXXXXXCXXXXCXBXXGXXXCXCXXGXXXXXXXXXC

SEQ ID NO: 417 - protein, 42 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
  MOD_RES (39)...(39): Gly or Arg
  MOD_RES (40)...(40): Lys or Asn
  MOD_RES (41)...(41): Ala or Asp
XDXBECXXXXXXCXXXXCXBXXGXXXCXCXXGXXXXXXXXXC

SEQ ID NO: 418 - protein, 41 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (12)...(12): Val, Thr or Ser
  MOD_RES (13)...(13): Ser, Arg or Asn
  MOD_RES (14)...(14): Gly, Asp or Asn
  MOD_RES (15)...(15): Ser, Arg or Gln
  MOD_RES (16)...(16): Ile or Lys
  MOD_RES (18)...(18): Val, Gln or Leu
  MOD_RES (20)...(20): Thr, Ser or Leu
  MOD_RES (21)...(21): Val, Gln or Pro
  MOD_RES (23)...(23): Ser or Gly
  MOD_RES (24)...(24): Thr or Phe
  MOD_RES (25)...(25): Ser, Arg or Gln
  MOD_RES (27)...(27): Val, Ser or Arg
  MOD_RES (29)...(29): Val, Pro or Leu
  MOD_RES (30)...(30): Gln, Pro or Glu
  MOD_RES (32)...(32): Tyr or Phe
  MOD_RES (33)...(33): Thr, Ser or Ala
  MOD_RES (34)...(34): Gly, Leu or Pro
  MOD_RES (35)...(35): Val, Thr or Gln
  MOD_RES (36)...(36): Ser, Arg or Asn
  MOD_RES (37)...(37): Ala or Asp
  MOD_RES (38)...(38): Gly or Arg
  MOD_RES (39)...(39): Lys or Asn
  MOD_RES (40)...(40): Ala or Asp
XDXBECXXXXCXXXXXCXBXXGXXXCXCXXGXXXXXXXXXC

SEQ ID NO: 419 - protein, 42 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (13)...(13): Val, Thr or Ser
  MOD_RES (14)...(14): Ser, Arg or Asn
  MOD_RES (15)...(15): Gly, Asp or Asn
  MOD_RES (16)...(16): Ser, Arg or Gln
  MOD_RES (17)...(17): Ile or Lys
  MOD_RES (19)...(19): Val, Gln or Leu
  MOD_RES (21)...(21): Thr, Ser or Leu
  MOD_RES (22)...(22): Val, Gln or Pro
  MOD_RES (24)...(24): Ser or Gly
  MOD_RES (25)...(25): Thr or Phe
  MOD_RES (26)...(26): Ser, Arg or Gln
  MOD_RES (28)...(28): Val, Ser or Arg
  MOD_RES (30)...(30): Val, Pro or Leu
  MOD_RES (31)...(31): Gln, Pro or Glu
  MOD_RES (33)...(33): Tyr or Phe
  MOD_RES (34)...(34): Thr, Ser or Ala
  MOD_RES (35)...(35): Gly, Leu or Pro
  MOD_RES (36)...(36): Val, Thr or Gln
  MOD_RES (37)...(37): Ser, Arg or Asn
  MOD_RES (38)...(38): Ala or Asp
  MOD_RES (39)...(39): Gly or Arg
  MOD_RES (40)...(40): Lys or Asn
  MOD_RES (41)...(41): Ala or Asp
XDXBECXXXXXCXXXXXCXBXXGXXXCXCXXGXXXXXXXXXC

SEQ ID NO: 420 - protein, 43 aa, Artificial Sequence
  Description of Artificial Sequence: Synthetic polypeptide
  MOD_RES (1)...(1): Val, Thr or Ile
  MOD_RES (3)...(3): Val or Ile
  MOD_RES (7)...(7): Val, Ser or Leu
  MOD_RES (8)...(8): Ser, Pro or Glu
  MOD_RES (9)...(9): Ser, Gly or Asn
  MOD_RES (10)...(10): Pro, Ala or Ser
  MOD_RES (11)...(11): Asp or Gly
  MOD_RES (12)...(12): Ala or Ile
  MOD_RES (14)...(14): Val, Thr or Ser
  MOD_RES (15)...(15): Ser, Arg or Asn
  MOD_RES (16)...(16): Gly, Asp or Asn
  MOD_RES (17)...(17): Ser, Arg or Gln
  MOD_RES (18)...(18): Ile or Lys
  MOD_RES (20)...(20): Val, Gln or Leu
  MOD_RES (22)...(22): Thr, Ser or Leu
  MOD_RES (23)...(23): Val, Gln or Pro
  MOD_RES (25)...(25): Ser or Gly
  MOD_RES (26)...(26): Thr or Phe
  MOD_RES (27)...(27): Ser, Arg or Gln
  MOD_RES (29)...(29): Val, Ser or Arg
  MOD_RES (31)...(31): Val, Pro or Leu
  MOD_RES (32)...(32): Gln, Pro or Glu
  MOD_RES (34)...(34): Tyr or Phe
  MOD_RES (35)...(35): Thr, Ser or Ala
  MOD_RES (36)...(36): Gly, Leu or Pro
  MOD_RES (37)...(37): Val, Thr or Gln
  MOD_RES (38)...(38): Ser, Arg or Asn
  MOD_RES (39)...(39): Ala or Asp
  MOD_RES (40)...(40): Gly or Arg
  MOD_RES (41)...(41): Lys or Asn
  MOD_RES (42)...(42): Ala or Asp
XDXBECXXXXXXCXXXXXCXBXXGXXXCXCXXGXXXXXXXXXC

SEQ ID NO: 421 - DNA, 31 bp, Artificial Sequence
  Description of Artificial Sequence: Synthetic oligonucleotide
aaaaggcctcgagggcctgggtggcaatggt

SEQ ID NO: 422 - DNA, 72 bp, Artificial Sequence
  Description of Artificial Sequence: Synthetic oligonucleotide
  modified_base (25)..(25): a, c, t, g, unknown or other
cctgaaccaccacakhkaccgyksnbgcacggayycgrcrmacattcatyaayatctdyaccattgccaccc

SEQ ID NO: 423 - DNA, 75 bp, Artificial Sequence
  Description of Artificial Sequence: Synthetic oligonucleotide
  modified_base (16)..(16): a, c, t, g, unknown or other
cctgaaccaccacakntgscgyygykmhsgcacggayycgrcrmacattcatyaayatctdyaccattgccaccc

SEQ ID NO: 424 - DNA, 78 bp, Artificial Sequence
  Description of Artificial Sequence: Synthetic oligonucleotide
  modified_base (25)..(25): a, c, t, g, unknown or other
cctgaaccaccacakhkaccgyksnbgcaarbaybcgvahycwskbyacattcatyaayatctdyaccattgccaccc

SEQ ID NO: 425 - DNA, 81 bp, Artificial Sequence
  Description of Artificial Sequence: Synthetic oligonucleotide
  modified_base (16)..(16): a, c, t, g, unknown or other
cctgaaccaccacakntgscgyygykmhsgcaarbaybcgvahycwskbyacattcatyaayatctdyaccattgccaccc

SEQ ID NO: 426 - DNA, 81 bp, Artificial Sequence
  Description of Artificial Sequence: Synthetic oligonucleotide
tgaattttctgtatgaggttttgctaaacaactttcaacagtttcggccccagaggccctggagccacctgaaccaccaca

SEQ ID NO: 427 - DNA, 50 bp, Artificial Sequence
  Description of Artificial Sequence: Synthetic oligonucleotide
acggtgcctacccgtatgatgttccggattatgccccgggtggcaatggt

SEQ ID NO: 428 - DNA, 84 bp, Artificial Sequence
  Description of Artificial Sequence: Synthetic oligonucleotide
cctgaaccaccacaghktdbaccgghawagcctkscrsgcashbacakykawagcyacccdstrwatytwbaccattgccaccc

SEQ ID NO: 429 - DNA, 96 bp, Artificial Sequence
  Description of Artificial Sequence: Synthetic oligonucleotide
  modified_base (34)..(34): a, c, t, g, unknown or other
cctgaaccaccacakbykbtkcygkycbsabycngcdbawagcctkbgbkgcashbacakykawagcyacccdstrwatytwbaccattgccaccc

SEQ ID NO: 430 - DNA, 31 bp, Artificial Sequence
  Description of Artificial Sequence: Synthetic oligonucleotide
aaaaggccccagaggcccctgaaccaccaca

SEQ ID NO: 431 - DNA, 31 bp, Artificial Sequence; identical to SEQ ID NO: 421
  Description of Artificial Sequence: Synthetic primer

SEQ ID NO: 432 - DNA, 31 bp, Artificial Sequence; identical to SEQ ID NO: 430
  Description of Artificial Sequence: Synthetic primer

SEQ ID NO: 433 - protein, 39 aa, Artificial Sequence
  Description of Artificial Sequence: Synthetic polypeptide
  MOD_RES (2)..(5): Variable amino acid
  MOD_RES (11)..(12): Variable amino acid
  MOD_RES (35)..(38): Variable amino acid
CXXXXEFRCAXXGRCIPSSWVCDGEDDCGDGSDEXXXXC

SEQ ID NO: 434 - protein, 40 aa, Artificial Sequence
  Description of Artificial Sequence: Synthetic polypeptide
  MOD_RES (2)..(5): Variable amino acid
  MOD_RES (11)..(12): Variable amino acid
  MOD_RES (35)..(39): Variable amino acid
CXXXXEFRCAXXGRCIPSSWVCDGEDDCGDGSDEXXXXXC

SEQ ID NO: 435 - protein, 41 aa, Artificial Sequence
  Description of Artificial Sequence: Synthetic polypeptide
  MOD_RES (2)..(5): Variable amino acid
  MOD_RES (11)..(12): Variable amino acid
  MOD_RES (35)..(40): Variable amino acid
CXXXXEFRCAXXGRCIPSSWVCDGEDDCGDGSDEXXXXXXC

SEQ ID NO: 436 - protein, 40 aa, Artificial Sequence
  Description of Artificial Sequence: Synthetic polypeptide
  MOD_RES (2)..(6): Variable amino acid
  MOD_RES (12)..(13): Variable amino acid
  MOD_RES (36)..(39): Variable amino acid
CXXXXXEFRCAXXGRCIPSSWVCDGEDDCGDGSDEXXXXC

SEQ ID NO: 437 - protein, 41 aa, Artificial Sequence
  Description of Artificial Sequence: Synthetic polypeptide
  MOD_RES (2)..(6): Variable amino acid
  MOD_RES (12)..(13): Variable amino acid
  MOD_RES (36)..(40): Variable amino acid
CXXXXXEFRCAXXGRCIPSSWVCDGEDDCGDGSDEXXXXXC

SEQ ID NO: 438 - protein, 42 aa, Artificial Sequence
  Description of Artificial Sequence: Synthetic polypeptide
  MOD_RES (2)..(6): Variable amino acid
  MOD_RES (12)..(13): Variable amino acid
  MOD_RES (36)..(41): Variable amino acid
CXXXXXEFRCAXXGRCIPSSWVCDGEDDCGDGSDEXXXXXXC

SEQ ID NO: 439 - protein, 41 aa, Artificial Sequence
  Description of Artificial Sequence: Synthetic polypeptide
  MOD_RES (2)..(7): Variable amino acid
  MOD_RES (13)..(14): Variable amino acid
  MOD_RES (37)..(40): Variable amino acid
CXXXXXXEFRCAXXGRCIPSSWVCDGEDDCGDGSDEXXXXC

SEQ ID NO: 440 - protein, 42 aa, Artificial Sequence
  Description of Artificial Sequence: Synthetic polypeptide
  MOD_RES (2)..(7): Variable amino acid
  MOD_RES (13)..(14): Variable amino acid
  MOD_RES (37)..(41): Variable amino acid
CXXXXXXEFRCAXXGRCIPSSWVCDGEDDCGDGSDEXXXXXC

SEQ ID NO: 441 - protein, 43 aa, Artificial Sequence
  Description of Artificial Sequence: Synthetic polypeptide
  MOD_RES (2)..(7): Variable amino acid
  MOD_RES (13)..(14): Variable amino acid
  MOD_RES (37)..(42): Variable amino acid
CXXXXXXEFRCAXXGRCIPSSWVCDGEDDCGDGSDEXXXXXXC

SEQ ID NO: 442 - protein, 40 aa, Artificial Sequence
  Description of Artificial Sequence: Synthetic polypeptide
  MOD_RES (2)..(5): Variable amino acid
  MOD_RES (11)..(13): Variable amino acid
  MOD_RES (36)..(39): Variable amino acid
CXXXXEFRCAXXXGRCIPSSWVCDGEDDCGDGSDEXXXXC

SEQ ID NO: 443 - protein, 41 aa, Artificial Sequence
  Description of Artificial Sequence: Synthetic polypeptide
  MOD_RES (2)..(5): Variable amino acid
  MOD_RES (11)..(13): Variable amino acid
  MOD_RES (36)..(40): Variable amino acid
CXXXXEFRCAXXXGRCIPSSWVCDGEDDCGDGSDEXXXXXC

SEQ ID NO: 444 - protein, 42 aa, Artificial Sequence
  Description of Artificial Sequence: Synthetic polypeptide
  MOD_RES (2)..(5): Variable amino acid
  MOD_RES (11)..(13): Variable amino acid
  MOD_RES (36)..(41): Variable amino acid
CXXXXEFRCAXXXGRCIPSSWVCDGEDDCGDGSDEXXXXXXC

SEQ ID NO: 445 - protein, 41 aa, Artificial Sequence
  Description of Artificial Sequence: Synthetic polypeptide
  MOD_RES (2)..(6): Variable amino acid
  MOD_RES (12)..(14): Variable amino acid
  MOD_RES (37)..(40): Variable amino acid
CXXXXXEFRCAXXXGRCIPSSWVCDGEDDCGDGSDEXXXXC

SEQ ID NO: 446 - protein, 42 aa, Artificial Sequence
  Description of Artificial Sequence: Synthetic polypeptide
  MOD_RES (2)..(6): Variable amino acid
  MOD_RES (12)..(14): Variable amino acid
  MOD_RES (37)..(41): Variable amino acid
CXXXXXEFRCAXXXGRCIPSSWVCDGEDDCGDGSDEXXXXXC

SEQ ID NO: 447 - protein, 43 aa, Artificial Sequence
  Description of Artificial Sequence: Synthetic polypeptide
  MOD_RES (2)..(6): Variable amino acid
  MOD_RES (12)..(14): Variable amino acid
  MOD_RES (37)..(42): Variable amino acid
CXXXXXEFRCAXXXGRCIPSSWVCDGEDDCGDGSDEXXXXXXC

SEQ ID NO: 448 - protein, 42 aa, Artificial Sequence
  Description of Artificial Sequence: Synthetic polypeptide
  MOD_RES (2)..(7): Variable amino acid
  MOD_RES (13)..(15): Variable amino acid
  MOD_RES (38)..(41): Variable amino acid
CXXXXXXEFRCAXXXGRCIPSSWVCDGEDDCGDGSDEXXXXC

SEQ ID NO: 449 - protein, 43 aa, Artificial Sequence
  Description of Artificial Sequence: Synthetic polypeptide
  MOD_RES (2)..(7): Variable amino acid
  MOD_RES (13)..(15): Variable amino acid
  MOD_RES (38)..(42): Variable amino acid
CXXXXXXEFRCAXXXGRCIPSSWVCDGEDDCGDGSDEXXXXXC

SEQ ID NO: 450 - protein, 44 aa, Artificial Sequence
  Description of Artificial Sequence: Synthetic polypeptide
  MOD_RES (2)..(7): Variable amino acid
  MOD_RES (13)..(15): Variable amino acid
  MOD_RES (38)..(43): Variable amino acid
CXXXXXXEFRCAXXXGRCIPSSWVCDGEDDCGDGSDEXXXXXXC

SEQ ID NO: 451 - protein, 41 aa, Artificial Sequence
  Description of Artificial Sequence: Synthetic polypeptide
  MOD_RES (2)..(5): Variable amino acid
  MOD_RES (11)..(14): Variable amino acid
  MOD_RES (37)..(40): Variable amino acid
CXXXXEFRCAXXXXGRCIPSSWVCDGEDDCGDGSDEXXXXC

SEQ ID NO: 452 - protein, 42 aa, Artificial Sequence
  Description of Artificial Sequence: Synthetic polypeptide
  MOD_RES (2)..(5): Variable amino acid
  MOD_RES (11)..(14): Variable amino acid
  MOD_RES (37)..(41): Variable amino acid
CXXXXEFRCAXXXXGRCIPSSWVCDGEDDCGDGSDEXXXXXC

SEQ ID NO: 453 - protein, 43 aa, Artificial Sequence
  Description of Artificial Sequence: Synthetic polypeptide
  MOD_RES (2)..(5): Variable amino acid
  MOD_RES (11)..(14): Variable amino acid
  MOD_RES (37)..(42): Variable amino acid
CXXXXEFRCAXXXXGRCIPSSWVCDGEDDCGDGSDEXXXXXXC

SEQ ID NO: 454 - protein, 42 aa, Artificial Sequence
  Description of Artificial Sequence: Synthetic polypeptide
  MOD_RES (2)..(6): Variable amino acid
  MOD_RES (12)..(15): Variable amino acid
  MOD_RES (38)..(41): Variable amino acid
CXXXXXEFRCAXXXXGRCIPSSWVCDGEDDCGDGSDEXXXXC

SEQ ID NO: 455 - protein, 43 aa, Artificial Sequence
  Description of Artificial Sequence: Synthetic polypeptide
  MOD_RES (2)..(6): Variable amino acid
  MOD_RES (12)..(15): Variable amino acid
  MOD_RES (38)..(42): Variable amino acid
CXXXXXEFRCAXXXXGRCIPSSWVCDGEDDCGDGSDEXXXXXC

SEQ ID NO: 456 - protein, 44 aa, Artificial Sequence
  Description of Artificial Sequence: Synthetic polypeptide
  MOD_RES (2)..(6): Variable amino acid
  MOD_RES (12)..(15): Variable amino acid
  MOD_RES (38)..(43): Variable amino acid
CXXXXXEFRCAXXXXGRCIPSSWVCDGEDDCGDGSDEXXXXXXC

SEQ ID NO: 457 - protein, 43 aa, Artificial Sequence
  Description of Artificial Sequence: Synthetic polypeptide
  MOD_RES (2)..(7): Variable amino acid
  MOD_RES (13)..(16): Variable amino acid
  MOD_RES (39)..(42): Variable amino acid
CXXXXXXEFRCAXXXXGRCIPSSWVCDGEDDCGDGSDEXXXXC

SEQ ID NO: 458 - protein, 44 aa, Artificial Sequence
  Description of Artificial Sequence: Synthetic polypeptide
  MOD_RES (2)..(7): Variable amino acid
  MOD_RES (13)..(16): Variable amino acid
  MOD_RES (39)..(43): Variable amino acid
CXXXXXXEFRCAXXXXGRCIPSSWVCDGEDDCGDGSDEXXXXXC

SEQ ID NO: 459 - protein, 45 aa, Artificial Sequence
  Description of Artificial Sequence: Synthetic polypeptide
  MOD_RES (2)..(7): Variable amino acid
  MOD_RES (13)..(16): Variable amino acid
  MOD_RES (39)..(44): Variable amino acid
CXXXXXXEFRCAXXXXGRCIPSSWVCDGEDDCGDGSDEXXXXXXC

SEQ ID NO: 460 - DNA, 56 bp, Artificial Sequence
  Description of Artificial Sequence: Synthetic oligonucleotide
  modified_base (36)..(37): a, c, t, g, unknown or other
  modified_base (39)..(40): a, c, t, g, unknown or other
  modified_base (42)..(43): a, c, t, g, unknown or other
  modified_base (45)..(46): a, c, t, g, unknown or other
atatcccgggtctggaggcgtctggtggttcgtgtnnknnknnknnkgaattccga

SEQ ID NO: 461 - DNA, 59 bp, Artificial Sequence
  Description of Artificial Sequence: Synthetic oligonucleotide
  modified_base (36)..(37): a, c, t, g, unknown or other
  modified_base (39)..(40): a, c, t, g, unknown or other
  modified_base (42)..(43): a, c, t, g, unknown or other
  modified_base (45)..(46): a, c, t, g, unknown or other
  modified_base (48)..(49): a, c, t, g, unknown or other
atatcccgggtctggaggcgtctggtggttcgtgtnnknnknnknnknnkgaattccga

SEQ ID NO: 462 - DNA, 62 bp, Artificial Sequence
  Description of Artificial Sequence: Synthetic oligonucleotide
  modified_base (36)..(37): a, c, t, g, unknown or other
  modified_base (39)..(40): a, c, t, g, unknown or other
  modified_base (42)..(43): a, c, t, g, unknown or other
  modified_base (45)..(46): a, c, t, g, unknown or other
  modified_base (48)..(49): a, c, t, g, unknown or other
  modified_base (51)..(52): a, c, t, g, unknown or other
atatcccgggtctggaggcgtctggtggttcgtgtnnknnknnknnknnknnkgaattccga

SEQ ID NO: 463 - DNA, 56 bp, Artificial Sequence
  Description of Artificial Sequence: Synthetic oligonucleotide
  modified_base (39)..(40): a, c, t, g, unknown or other
  modified_base (42)..(43): a, c, t, g, unknown or other
  modified_base (45)..(46): a, c, t, g, unknown or other
atatcccgggtctggaggcgtctggtggttcgtgttatnnknnknnkgaattccga

SEQ ID NO: 464 - DNA, 59 bp, Artificial Sequence
  Description of Artificial Sequence: Synthetic oligonucleotide
  modified_base (36)..(37): a, c, t, g, unknown or other
  modified_base (42)..(43): a, c, t, g, unknown or other
  modified_base (45)..(46): a, c, t, g, unknown or other
  modified_base (48)..(49): a, c, t, g, unknown or other
atatcccgggtctggaggcgtctggtggttcgtgtnnktatnnknnknnkgaattccga

SEQ ID NO: 465 - DNA, 56 bp, Artificial Sequence
  Description of Artificial Sequence: Synthetic oligonucleotide
  modified_base (36)..(37): a, c, t, g, unknown or other
  modified_base (42)..(43): a, c, t, g, unknown or other
  modified_base (45)..(46): a, c, t, g, unknown or other
atatcccgggtctggaggcgtctggtggttcgtgtnnktatnnknnkgaattccga

SEQ ID NO: 466 - DNA, 56 bp, Artificial Sequence
  Description of Artificial Sequence: Synthetic oligonucleotide
  modified_base (36)..(37): a, c, t, g, unknown or other
  modified_base (39)..(40): a, c, t, g, unknown or other
  modified_base (45)..(46): a, c, t, g, unknown or other
atatcccgggtctggaggcgtctggtggttcgtgtnnknnktatnnkgaattccga

SEQ ID NO: 467 - DNA, 56 bp, Artificial Sequence
  Description of Artificial Sequence: Synthetic oligonucleotide
  modified_base (36)..(37): a, c, t, g, unknown or other
  modified_base (39)..(40): a, c, t, g, unknown or other
  modified_base (42)..(43): a, c, t, g, unknown or other
atatcccgggtctggaggcgtctggtggttcgtgtnnknnknnktatgaattccga

SEQ ID NO: 468 - DNA, 59 bp, Artificial Sequence
  Description of Artificial Sequence: Synthetic oligonucleotide
  modified_base (36)..(37): a, c, t, g, unknown or other
  modified_base (39)..(40): a, c, t, g, unknown or other
  modified_base (42)..(43): a, c, t, g, unknown or other
  modified_base (48)..(49): a, c, t, g, unknown or other
atatcccgggtctggaggcgtctggtggttcgtgtnnknnknnktatnnkgaattccga

SEQ ID NO: 469 - DNA, 49 bp, Artificial Sequence
  Description of Artificial Sequence: Synthetic oligonucleotide
  modified_base (30)..(31): a, c, t, g, unknown or other
  modified_base (33)..(34): a, c, t, g, unknown or other
atacccaagaagacggtatacatcgtccmnnmnntgcacatcggaattc

SEQ ID NO: 470 - DNA, 52 bp, Artificial Sequence
  Description of Artificial Sequence: Synthetic oligonucleotide
  modified_base (30)..(31): a, c, t, g, unknown or other
  modified_base (33)..(34): a, c, t, g, unknown or other
  modified_base (36)..(37): a, c, t, g, unknown or other
atacccaagaagacggtatacatcgtccmnnmnnmnntgcacatcggaattc

SEQ ID NO: 471 - DNA, 55 bp, Artificial Sequence
  Description of Artificial Sequence: Synthetic oligonucleotide
  modified_base (30)..(31): a, c, t, g, unknown or other
  modified_base (33)..(34): a, c, t, g, unknown or other
  modified_base (36)..(37): a, c, t, g, unknown or other
  modified_base (39)..(40): a, c, t, g, unknown or other
atacccaagaagacggtatacatcgtccmnnmnnmnnmnntgcacatcggaattc

SEQ ID NO: 472 - DNA, 52 bp, Artificial Sequence
  Description of Artificial Sequence: Synthetic oligonucleotide
  modified_base (33)..(34): a, c, t, g, unknown or other
  modified_base (36)..(37): a, c, t, g, unknown or other
atacccaagaagacggtatacatcgtccatamnnmnntgcacatcggaattc

SEQ ID NO: 473 - DNA, 55 bp, Artificial Sequence
  Description of Artificial Sequence: Synthetic oligonucleotide
  modified_base (30)..(31): a, c, t, g, unknown or other
  modified_base (36)..(37): a, c, t, g, unknown or other
  modified_base (39)..(40): a, c, t, g, unknown or other
atacccaagaagacggtatacatcgtccmnnatamnnmnntgcacatcggaattc

SEQ ID NO: 474 - DNA, 52 bp, Artificial Sequence
  Description of Artificial Sequence: Synthetic oligonucleotide
  modified_base (30)..(31): a, c, t, g, unknown or other
  modified_base (36)..(37): a, c, t, g, unknown or other
atacccaagaagacggtatacatcgtccmnnatamnntgcacatcggaattc

SEQ ID NO: 475 - DNA, 52 bp, Artificial Sequence
  Description of Artificial Sequence: Synthetic oligonucleotide
  modified_base (30)..(31): a, c, t, g, unknown or other
  modified_base (33)..(34): a, c, t, g, unknown or other
atacccaagaagacggtatacatcgtccmnnmnnatatgcacatcggaattc

SEQ ID NO: 476 - DNA, 55 bp, Artificial Sequence
  Description of Artificial Sequence: Synthetic oligonucleotide
  modified_base (30)..(31): a, c, t, g, unknown or other
  modified_base (33)..(34): a, c, t, g, unknown or other
  modified_base (39)..(40): a, c, t, g, unknown or other
atacccaagaagacggtatacatcgtccmnnmnnatamnntgcacatcggaattc

SEQ ID NO: 477 - DNA, 55 bp, Artificial Sequence
  Description of Artificial Sequence: Synthetic oligonucleotide
accgtcttcttgggtatgtgacggggaggacgattgtggtgacggatctgacgag

SEQ ID NO: 478 - DNA, 66 bp, Artificial Sequence
  Description of Artificial Sequence: Synthetic oligonucleotide
  modified_base (42)..(43): a, c, t, g, unknown or other
  modified_base (45)..(46): a, c, t, g, unknown or other
  modified_base (48)..(49): a, c, t, g, unknown or other
  modified_base (51)..(52): a, c, t, g, unknown or other
atatggccccagaggcctgcaatgatccaccgcccccacamnnmnnmnnmnnctcgtcagatccgt

SEQ ID NO: 479 - DNA, 69 bp, Artificial Sequence
  Description of Artificial Sequence: Synthetic oligonucleotide
  modified_base (42)..(43): a, c, t, g, unknown or other
  modified_base (45)..(46): a, c, t, g, unknown or other
  modified_base (48)..(49): a, c, t, g, unknown or other
  modified_base (51)..(52): a, c, t, g, unknown or other
  modified_base (54)..(55): a, c, t, g, unknown or other
atatggccccagaggcctgcaatgatccaccgcccccacamnnmnnmnnmnnmnnctcgtcagatccgt

SEQ ID NO: 480 - DNA, 72 bp, Artificial Sequence
  Description of Artificial Sequence: Synthetic oligonucleotide
  modified_base (42)..(43): a, c, t, g, unknown or other
  modified_base (45)..(46): a, c, t, g, unknown or other
  modified_base (48)..(49): a, c, t, g, unknown or other
  modified_base (51)..(52): a, c, t, g, unknown or other
  modified_base (54)..(55): a, c, t, g, unknown or other
  modified_base (57)..(58): a, c, t, g, unknown or other
atatggccccagaggcctgcaatgatccaccgcccccacamnnmnnmnnmnnmnnmnnctcgtcagatccgt

SEQ ID NO: 481 - DNA, 66 bp, Artificial Sequence
  Description of Artificial Sequence: Synthetic oligonucleotide
  modified_base (45)..(46): a, c, t, g, unknown or other
  modified_base (48)..(49): a, c, t, g, unknown or other
  modified_base (51)..(52): a, c, t, g, unknown or other
atatggccccagaggcctgcaatgatccaccgcccccacaatamnnmnnmnnctcgtcagatccgt

SEQ ID NO: 482 - DNA, 69 bp, Artificial Sequence
  Description of Artificial Sequence: Synthetic oligonucleotide
  modified_base (42)..(43): a, c, t, g, unknown or other
  modified_base (48)..(49): a, c, t, g, unknown or other
  modified_base (51)..(52): a, c, t, g, unknown or other
  modified_base (54)..(55): a, c, t, g, unknown or other
atatggccccagaggcctgcaatgatccaccgcccccacamnnatamnnmnnmnnctcgtcagatccgt

SEQ ID NO: 483 - DNA, 66 bp, Artificial Sequence
  Description of Artificial Sequence: Synthetic oligonucleotide
  modified_base (42)..(43): a, c, t, g, unknown or other
  modified_base (48)..(49): a, c, t, g, unknown or other
  modified_base (51)..(52): a, c, t, g, unknown or other
atatggccccagaggcctgcaatgatccaccgcccccacamnnatamnnmnnctcgtcagatccgt

SEQ ID NO: 484 - DNA, 66 bp, Artificial Sequence
  Description of Artificial Sequence: Synthetic oligonucleotide
  modified_base (42)..(43): a, c, t, g, unknown or other
  modified_base (45)..(46): a, c, t, g, unknown or other
  modified_base (51)..(52): a, c, t, g, unknown or other
atatggccccagaggcctgcaatgatccaccgcccccacamnnmnnatamnnctcgtcagatccgt

SEQ ID NO: 485 - DNA, 66 bp, Artificial Sequence
  Description of Artificial Sequence: Synthetic oligonucleotide
  modified_base (42)..(43): a, c, t, g, unknown or other
  modified_base (45)..(46): a, c, t, g, unknown or other
  modified_base (48)..(49): a, c, t, g, unknown or other
atatggccccagaggcctgcaatgatccaccgcccccacamnnmnnmnnatactcgtcagatccgt

SEQ ID NO: 486 - DNA, 69 bp, Artificial Sequence
  Description of Artificial Sequence: Synthetic oligonucleotide
  modified_base (42)..(43): a, c, t, g, unknown or other
  modified_base (45)..(46): a, c, t, g, unknown or other
  modified_base (48)..(49): a, c, t, g, unknown or other
  modified_base (54)..(55): a, c, t, g, unknown or other
atatggccccagaggcctgcaatgatccaccgcccccacamnnmnnmnnatamnnctcgtcagatccgt

SEQ ID NO: 487 - protein, 35 aa, Artificial Sequence
  Description of Artificial Sequence: Synthetic polypeptide
  MOD_RES (2)..(5): Variable amino acid
  MOD_RES (7)..(7): Variable amino acid
  MOD_RES (9)..(12): Variable amino acid
  MOD_RES (15)..(17): Variable amino acid
  MOD_RES (19)..(19): Variable amino acid
  MOD_RES (23)..(24): Variable amino acid
  MOD_RES (27)..(27): Variable amino acid
  MOD_RES (29)..(29): Variable amino acid
  MOD_RES (33)..(34): Variable amino acid
CXXXXFXCXXXXCIXXXWXCDGXXDCXDXSDEXXC

SEQ ID NO: 488 - DNA, 25 bp, Artificial Sequence
  Description of Artificial Sequence: Synthetic primer
attatgccccgggtctggaggcgtc

SEQ ID NO: 489 - DNA, 11 bp, Artificial Sequence
  Description of Artificial Sequence: Synthetic primer
cgccgtcgcaa

SEQ ID NO: 490 - DNA, 11 bp, Artificial Sequence
  Description of Artificial Sequence: Synthetic primer
ttgcgacggcg

SEQ ID NO: 491 - DNA, 22 bp, Artificial Sequence
  Description of Artificial Sequence: Synthetic primer
tcggccccagaggcctgcaatg

SEQ ID NO: 492 - DNA, 23 bp, Artificial Sequence
  Description of Artificial Sequence: Synthetic primer
ccggattatgccccgggtctgga

SEQ ID NO: 493 - DNA, 25 bp, Artificial Sequence
  Description of Artificial Sequence: Synthetic primer
aacagtttcggccccagaggcctgc

SEQ ID NO: 494 - DNA, 40 bp, Artificial Sequence
  Description of Artificial Sequence: Synthetic primer
atcatctggccggtccggcctacccgtatgatgttccgga

SEQ ID NO: 495 - DNA, 29 bp, Artificial Sequence
  Description of Artificial Sequence: Synthetic primer
aaaaggccccagaggccttctgcaatgac

SEQ ID NO: 496 - DNA, 22 bp, Artificial Sequence
  Description of Artificial Sequence: Synthetic oligonucleotide
acccgtatgatgttccggatta

SEQ ID NO: 497 - DNA, 31 bp, Artificial Sequence
  Description of Artificial Sequence: Synthetic oligonucleotide
gatgtattcggccccagaggcctgcaatgac

SEQ ID NO: 498 - DNA, 20 bp, Artificial Sequence
  Description of Artificial Sequence: Synthetic oligonucleotide
gaaattcacctcgaaagcaa

SEQ ID NO: 499 - DNA, 18 bp, Artificial Sequence
  Description of Artificial Sequence: Synthetic oligonucleotide
atgggttcctattgggct

SEQ ID NO: 500 - protein, 39 aa, Artificial Sequence
  Description of Artificial Sequence: Synthetic polypeptide
CPSDEFRCRNGRCIPRAWRCDGVNDCADNSDEEDCTEHT

SEQ ID NO: 501 - protein, 39 aa, Artificial Sequence
  Description of Artificial Sequence: Synthetic polypeptide
CPSDEFRCRNGRCVPRAWRCDGVNDCADNSDEEDCTEHT

SEQ ID NO: 502 - protein, 39 aa, Artificial Sequence
  Description of Artificial Sequence: Synthetic polypeptide
CPSDEFRCRNGRCIPRAWRCDGVNDCADNSDEEDCTENT

SEQ ID NO: 503 - protein, 39 aa, Artificial Sequence
  Description of Artificial Sequence: Synthetic polypeptide
CPSDEFRCRNGRCIPRAWRCDGVNDCADNSDEEDCTQHT

SEQ ID NO: 504 - protein, 39 aa, Artificial Sequence
  Description of Artificial Sequence: Synthetic polypeptide
CPSDEFRCRNGRCIPRAWRCDGVNDCADNSDEEGCTPHT

SEQ ID NO: 505 - protein, 39 aa, Artificial Sequence
  Description of Artificial Sequence: Synthetic polypeptide
CPSDEFRCRNGRCIPRAWRCDGVNDCADNSDEADCKAHT

SEQ ID NO: 506 - protein, 39 aa, Artificial Sequence
  Description of Artificial Sequence: Synthetic polypeptide
CPSDEFRCRNGRCIPRAWRCDGVNDCADNSDEADCAAPT

SEQ ID NO: 507 - protein, 39 aa, Artificial Sequence
  Description of Artificial Sequence: Synthetic polypeptide
CPSDEFRCRNGRCIPRAWRCDGVNDCGDNSDETNCAPPT

SEQ ID NO: 508 - protein, 46 aa, Artificial Sequence
  Description of Artificial Sequence: Synthetic polypeptide
CPSDEFRCRNGRCIPRAWRCDGVNDCGDSSDETSCSAPASEPPGSL

SEQ ID NO: 509 - protein, 41 aa, Artificial Sequence
  Description of Artificial Sequence: Synthetic polypeptide
CPSDEFRCRNGRCIPRAWRCDGVNDCADNSDEANCAGSVPT

SEQ ID NO: 510 - protein, 39 aa, Artificial Sequence
  Description of Artificial Sequence: Synthetic polypeptide
CPASEFRCNNGRCIPAQWRCDGVNDCGDDSDEASCQAPT

SEQ ID NO: 511 - protein, 41 aa, Artificial Sequence
  Description of Artificial Sequence: Synthetic polypeptide
CQANEFTCSSGNCLSPALLCDGVDDCGDNSDETNCASPAPT

SEQ ID NO: 512 - protein, 41 aa, Artificial Sequence
  Description of Artificial Sequence: Synthetic polypeptide
CQANEFTCSSGNCLSPALLCDGVDDCGDNSDETYCASPAPT

SEQ ID NO: 513 - protein, 41 aa, Artificial Sequence
  Description of Artificial Sequence: Synthetic polypeptide
CQANEFTCSSGNCLSPALLCDGVDDCGDNSDETYCAGPAPT

SEQ ID NO: 514 - protein, 41 aa, Artificial Sequence
  Description of Artificial Sequence: Synthetic polypeptide
CELNEFTCSSGNCLSPALLCDGVDDCGDNSDETNCASPAPT

SEQ ID NO: 515 - protein, 39 aa, Artificial Sequence
  Description of Artificial Sequence: Synthetic polypeptide
CGANEFTCDNGRCLSPDLVCDGVDDCADSSDETDCQKPM

SEQ ID NO: 516 - protein, 41 aa, Artificial Sequence
  Description of Artificial Sequence: Synthetic polypeptide
CRPDEFKCENGHCIPPGLRCDGVDDCVDNSDETDCETPGRT

SEQ ID NO: 517 - protein, 41 aa, Artificial Sequence
  Description of Artificial Sequence: Synthetic polypeptide
CPSDEFRCRNGRCIPPGWLCDGVDDCVDDSDEEGCRTPART

SEQ ID NO: 518 - protein, 41 aa, Artificial Sequence
  Description of Artificial Sequence: Synthetic polypeptide
CGSNEFTCSNGRCIPPTLLCDGVNDCGDDSDETGCATPVRT

SEQ ID NO: 519 - protein, 43 aa, Artificial Sequence
  Description of Artificial Sequence: Synthetic polypeptide
CASSQFPCDNGKCLPPPLVCDGVDDCGDDSDEPSAPCGSPART

SEQ ID NO: 520 - protein, 43 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(43): Variable amino acid
CXXXXFXCXXGXCXXXXXXCDGVXDCXDXSDEXXXXXXXXXXX

SEQ ID NO: 521 - protein, 43 aa, Artificial Sequence
  Description of Artificial Sequence: Synthetic polypeptide
  MOD_RES (2)..(4): Variable amino acid
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(43): Variable amino acid
CXXXEFXCXXGXCXXXXXXCDGVXDCXDXSDEXXCXXXXXXXX

SEQ ID NO: 522 - protein, 43 aa, Artificial Sequence; identical to SEQ ID NO: 521
  Description of Artificial Sequence: Synthetic polypeptide
  MOD_RES (2)..(3): Variable amino acid
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(43): Variable amino acid

SEQ ID NO: 523 - protein, 43 aa, Artificial Sequence; identical to SEQ ID NO: 521
  Description of Artificial Sequence: Synthetic polypeptide
  MOD_RES (2)..(3): Variable amino acid
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (24)..(24): Asp or Asn
  MOD_RES (27)..(27): Variable amino acid
  MOD_RES (29)..(29): Asp or Asn
  MOD_RES (33)..(34): Variable amino acid
  MOD_RES (36)..(43): Variable amino acid

SEQ ID NO: 524 - protein, 43 aa, Artificial Sequence; identical to SEQ ID NO: 521
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (24)..(24): Asp or Asn
  MOD_RES (27)..(27): Variable amino acid
  MOD_RES (29)..(29): Asp or Asn
  MOD_RES (33)..(34): Variable amino acid
  MOD_RES (36)..(43): Variable amino acid

SEQ ID NO: 525 - protein, 43 aa, Artificial Sequence; identical to SEQ ID NO: 521
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(16): Variable amino acid
  MOD_RES (17)..(17): Ala, Ser or Thr
  MOD_RES (18)..(19): Variable amino acid
  MOD_RES (24)..(24): Asp or Asn
  MOD_RES (27)..(27): Variable amino acid
  MOD_RES (29)..(29): Asp or Asn
  MOD_RES (33)..(34): Variable amino acid
  MOD_RES (36)..(43): Variable amino acid

SEQ ID NO: 526 - protein, 43 aa, Artificial Sequence
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(16): Variable amino acid
  MOD_RES (18)..(19): Variable amino acid
  MOD_RES (24)..(24): Asp or Asn
  MOD_RES (27)..(27): Variable amino acid
  MOD_RES (33)..(34): Variable amino acid
  MOD_RES (36)..(43): Variable amino acid
CXXXEFXCXXGXCXXXAXXCDGVXDCXDNSDEXXCXXXXXXXX

SEQ ID NO: 527 - protein, 43 aa, Artificial Sequence; identical to SEQ ID NO: 526
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(16): Variable amino acid
  MOD_RES (18)..(19): Variable amino acid
  MOD_RES (24)..(24): Asp or Asn
  MOD_RES (27)..(27): Variable amino acid
  MOD_RES (33)..(34): Variable amino acid
  MOD_RES (36)..(36): Ala, Ser or Thr
  MOD_RES (37)..(43): Variable amino acid

SEQ ID NO: 528 - protein, 43 aa, Artificial Sequence; identical to SEQ ID NO: 526
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(16): Variable amino acid
  MOD_RES (18)..(19): Variable amino acid
  MOD_RES (24)..(24): Asp or Asn
  MOD_RES (27)..(27): Variable amino acid
  MOD_RES (33)..(34): Variable amino acid
  MOD_RES (36)..(36): Ala, Ser or Thr
  MOD_RES (37)..(37): Variable amino acid
  MOD_RES (38)..(38): Ala, Ser or Thr
  MOD_RES (39)..(43): Variable amino acid

SEQ ID NO: 529 - protein, 46 aa, Artificial Sequence
  Description of Artificial Sequence: Synthetic polypeptide
CLSSQFQCDNGNCVPQQWVCDGDNDCLDDSDETSCSAPASEPPGSL

SEQ ID NO: 530 - protein, 39 aa, Artificial Sequence
  Description of Artificial Sequence: Synthetic polypeptide
CLADQFQCNNGRCVPQSWGCDGDDDCQDNSDETSCAPPT

SEQ ID NO: 531 - protein, 46 aa, Artificial Sequence
  Description of Artificial Sequence: Synthetic polypeptide
CAPGEFTCGSGRCVPQTWRCDGVDDCLDSSDETDCSAPASEPPGSL

SEQ ID NO: 532 - protein, 39 aa, Artificial Sequence
  Description of Artificial Sequence: Synthetic polypeptide
CPPGQFTCNNGRCVPPTWLCDGEDDCQDDSDEKNCKAPT

SEQ ID NO: 533 - protein, 39 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (16)..(17): Variable amino acid
  MOD_RES (19)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(37): Variable amino acid
  MOD_RES (39)..(39): Ala, Ser or Thr
CXXXXFXCXXGXCVPXXWXCDGXXDCXDXSDEXXCXXPX

SEQ ID NO: 534 - protein, 39 aa, Artificial Sequence; identical to SEQ ID NO: 28
  Description of Artificial Sequence: Synthetic polypeptide
  MOD_RES (2)..(4): Variable amino acid
  MOD_RES (7)..(7): Variable amino acid
  MOD_RES (9)..(9): Asp or Asn
  MOD_RES (12)..(12): Variable amino acid
  MOD_RES (16)..(17): Variable amino acid
  MOD_RES (19)..(19): Variable amino acid
  MOD_RES (23)..(23): Asp or Glu
  MOD_RES (24)..(24): Asp or Asn
  MOD_RES (27)..(27): Variable amino acid
  MOD_RES (29)..(29): Asp or Asn
  MOD_RES (33)..(34): Variable amino acid
  MOD_RES (36)..(37): Variable amino acid
  MOD_RES (39)..(39): Ala, Ser or Thr

SEQ ID NO: 535 - protein, 39 aa, Artificial Sequence
  Description of Artificial Sequence: Synthetic polypeptide
CRASQFQCGSGYCIPRPWLCDGDNDCEDDSDETNCTPRT

SEQ ID NO: 536 - protein, 39 aa, Artificial Sequence
  Description of Artificial Sequence: Synthetic polypeptide
CLPSQFQCRNGRCIPLPWLCDGDNDCEDDSDETNCTPRT

SEQ ID NO: 537 - protein, 48 aa, Artificial Sequence
  Description of Artificial Sequence: Synthetic polypeptide
CEADQFQCGSGYCLPRHWVCDGDNDCEDDSDETDCGRPGPGATSAPAV

SEQ ID NO: 538 - protein, 41 aa, Artificial Sequence
  Description of Artificial Sequence: Synthetic polypeptide
CLPSQFQCGSGYCISQRWVCDGEHDCEDSSDEANCAGSVPT

SEQ ID NO: 539 - protein, 41 aa, Artificial Sequence
  Description of Artificial Sequence: Synthetic polypeptide
CLPSQFQCGSGYCISQRWVCDGENDCEDSSDEANCAGSVPT

SEQ ID NO: 540 - protein, 41 aa, Artificial Sequence
  Description of Artificial Sequence: Synthetic polypeptide
CPSSQFQCSSGWCISQRWVCDGENDCEDSSDEANCAGSVPT

SEQ ID NO: 541 - protein, 41 aa, Artificial Sequence
  Description of Artificial Sequence: Synthetic polypeptide
CPSSQFQCSSGWCISQRWVCDGENDCEDGSDEANCAGSVPT

SEQ ID NO: 542 - protein, 34 aa, Artificial Sequence
  Description of Artificial Sequence: Synthetic polypeptide
CSSGWCISQRWVCDGENDCEDSSDEANCAGSVPT

SEQ ID NO: 543 - protein, 41 aa, Artificial Sequence
  Description of Artificial Sequence: Synthetic polypeptide
CPSSQFQCGSGWCISQHWVCDGENDCEDGSDEANCAGSVPT

SEQ ID NO: 544 - protein, 41 aa, Artificial Sequence
  Description of Artificial Sequence: Synthetic polypeptide
CLPSQFQCGSGWCISQRWVCDGENDCEDSSDEANCAGSVPT

SEQ ID NO: 545 - protein, 41 aa, Artificial Sequence
  Description of Artificial Sequence: Synthetic polypeptide
CLPSQFRCGSGCCFSQRWVCDGKNDCEDSSDEANCAGSLPT

SEQ ID NO: 546 - protein, 41 aa, Artificial Sequence
  Description of Artificial Sequence: Synthetic polypeptide
CGASQFQCGSGYCISQRWVCDGENDCEDSSDEANCAGSVPT

SEQ ID NO: 547 - protein, 41 aa, Artificial Sequence
  Description of Artificial Sequence: Synthetic polypeptide
CLPSQFQCGSGYCISQRWVCDGENDCEDGSDEANCAGSVPT

SEQ ID NO: 548 - protein, 41 aa, Artificial Sequence
  Description of Artificial Sequence: Synthetic polypeptide
CAPSQFQCGSGYCISQRWVCDGENDCEDGSDEANCAGSVPT

SEQ ID NO: 549 - protein, 41 aa, Artificial Sequence
  Description of Artificial Sequence: Synthetic polypeptide
CLPDQFQCGSGYCISQRWVCDGENDCEDSSDEANCAGSVPT

SEQ ID NO: 550 - protein, 41 aa, Artificial Sequence
  Description of Artificial Sequence: Synthetic polypeptide
CLPGQFQCGSGYCISQRWVCDGENDCEDGSDEANCAGSVPT

SEQ ID NO: 551 - protein, 41 aa, Artificial Sequence
  Description of Artificial Sequence: Synthetic polypeptide
CLPDQFQCGSGYCISQRWVCDGENDCEDGSDEANCAGSVPT

SEQ ID NO: 552 - protein, 41 aa, Artificial Sequence
  Description of Artificial Sequence: Synthetic polypeptide
CLPDQFQCGSGYCLSQRWVCDGENDCEDGSDEANCAGSVPT

SEQ ID NO: 553 - protein, 41 aa, Artificial Sequence
  Description of Artificial Sequence: Synthetic polypeptide
CLPDQFQCGSGYCLPQRWVCDGENDCEDSSDEANCAGSVPT

SEQ ID NO: 554 - protein, 41 aa, Artificial Sequence
  Description of Artificial Sequence: Synthetic polypeptide
CLPDQFQCGSGYCLPQRWVCDGENDCEDGSDEANCAGSVPT

SEQ ID NO: 555 - protein, 41 aa, Artificial Sequence
  Description of Artificial Sequence: Synthetic polypeptide
  MOD_RES (2)..(4): Variable amino acid
  MOD_RES (7)..(7): Lys, Gln or Arg
  MOD_RES (9)..(10): Variable amino acid
  MOD_RES (12)..(12): Variable amino acid
  MOD_RES (14)..(14): Phe, Ile, Leu, Met or Val
  MOD_RES (15)..(17): Variable amino acid
  MOD_RES (19)..(19): Ile, Leu or Val
  MOD_RES (23)..(24): Variable amino acid
  MOD_RES (29)..(29): Variable amino acid
  MOD_RES (33)..(33): Ala, Ser or Thr
  MOD_RES (34)..(34): Asp or Asn
  MOD_RES (36)..(41): Variable amino acid
CXXXQFXCXXGXCXXXXWXCDGXXDCEDXSDEXXCXXXXXX

SEQ ID NO: 556 - protein, 41 aa, Artificial Sequence
  Description of Artificial Sequence: Synthetic polypeptide
  MOD_RES (2)..(4): Variable amino acid
  MOD_RES (7)..(7): Lys, Gln or Arg
  MOD_RES (9)..(9): Variable amino acid
  MOD_RES (12)..(12): Variable amino acid
  MOD_RES (14)..(14): Phe, Ile, Leu, Met or Val
  MOD_RES (15)..(15): Variable amino acid
  MOD_RES (16)..(16): Lys, Gln or Arg
  MOD_RES (17)..(17): Variable amino acid
  MOD_RES (19)..(19): Ile, Leu or Val
  MOD_RES (23)..(24): Variable amino acid
  MOD_RES (29)..(29): Variable amino acid
  MOD_RES (33)..(33): Ala, Ser or Thr
  MOD_RES (34)..(34): Asp or Asn
  MOD_RES (36)..(41): Variable amino acid
CXXXQFXCXSGXCXXXXWXCDGXXDCEDXSDEXXCXXXXXX

SEQ ID NO: 557 - protein, 41 aa, Artificial Sequence
  Description of Artificial Sequence: Synthetic polypeptide
  MOD_RES (2)..(4): Variable amino acid
  MOD_RES (9)..(9): Variable amino acid
  MOD_RES (12)..(12): Phe, Trp or Tyr
  MOD_RES (14)..(14): Ile, Leu or Val
  MOD_RES (15)..(15): Variable amino acid
  MOD_RES (16)..(16): Lys, Gln or Arg
  MOD_RES (17)..(17): Variable amino acid
  MOD_RES (19)..(19): Ile, Leu or Val
  MOD_RES (23)..(23): Asp or Glu
  MOD_RES (24)..(24): Variable amino acid
  MOD_RES (29)..(29): Variable amino acid
  MOD_RES (33)..(33): Ala, Ser or Thr
  MOD_RES (34)..(34): Asp or Asn
  MOD_RES (36)..(41): Variable amino acid
CXXXQFQCXSGXCXXXXWXCDGXXDCEDXSDEXXCXXXXXX

SEQ ID NO: 558 - protein, 41 aa, Artificial Sequence
  Description of Artificial Sequence: Synthetic polypeptide
  MOD_RES (2)..(4): Variable amino acid
  MOD_RES (9)..(9): Variable amino acid
  MOD_RES (12)..(12): Phe, Trp or Tyr
  MOD_RES (14)..(14): Ile, Leu or Val
  MOD_RES (15)..(15): Variable amino acid
  MOD_RES (16)..(16): Lys, Gln or Arg
  MOD_RES (17)..(17): Variable amino acid
  MOD_RES (19)..(19): Ile, Leu or Val
  MOD_RES (23)..(23): Asp or Glu
  MOD_RES (29)..(29): Variable amino acid
  MOD_RES (33)..(33): Ala, Ser or Thr
  MOD_RES (34)..(34): Asp or Asn
  MOD_RES (36)..(41): Variable amino acid
CXXXQFQCXSGXCXXXXWXCDGXNDCEDXSDEXXCXXXXXX

SEQ ID NO: 559 - protein, 41 aa, Artificial Sequence
  Description of Artificial Sequence: Synthetic polypeptide
  MOD_RES (2)..(4): Variable amino acid
  MOD_RES (7)..(7): Lys, Gln or Arg
  MOD_RES (9)..(9): Variable amino acid
  MOD_RES (12)..(12): Variable amino acid
  MOD_RES (14)..(14): Phe, Ile, Leu, Met or Val
  MOD_RES (15)..(15): Variable amino acid
  MOD_RES (17)..(17): Variable amino acid
  MOD_RES (23)..(23): Glu, Lys or Gln
  MOD_RES (24)..(24): Variable amino acid
  MOD_RES (29)..(29): Variable amino acid
  MOD_RES (39)..(39): Ile, Leu or Val
CXXXQFXCXSGXCXXQXWVCDGXXDCEDXSDEANCAGSXPT

SEQ ID NO: 560 - protein, 41 aa, Artificial Sequence
  Description of Artificial Sequence: Synthetic polypeptide
  MOD_RES (2)..(4): Variable amino acid
  MOD_RES (9)..(9): Variable amino acid
  MOD_RES (12)..(12): Phe, Trp or Tyr
  MOD_RES (14)..(14): Ile, Leu or Val
  MOD_RES (15)..(15): Variable amino acid
  MOD_RES (17)..(17): Variable amino acid
  MOD_RES (24)..(24): Variable amino acid
  MOD_RES (29)..(29): Variable amino acid
CXXXQFQCXSGXCXXQXWVCDGEXDCEDXSDEANCAGSVPT

SEQ ID NO: 561 - protein, 41 aa, Artificial Sequence
  Description of Artificial Sequence: Synthetic polypeptide
  MOD_RES (2)..(4): Variable amino acid
  MOD_RES (9)..(9): Variable amino acid
  MOD_RES (12)..(12): Phe, Trp or Tyr
  MOD_RES (14)..(14): Ile, Leu or Val
  MOD_RES (15)..(15): Variable amino acid
  MOD_RES (17)..(17): Variable amino acid
  MOD_RES (29)..(29): Variable amino acid
CXXXQFQCXSGXCXXQXWVCDGENDCEDXSDEANCAGSVPT

SEQ ID NO: 562 - protein, 41 aa, Artificial Sequence
  Description of Artificial Sequence: Synthetic polypeptide
  MOD_RES (2)..(4): Variable amino acid
  MOD_RES (9)..(9): Variable amino acid
  MOD_RES (12)..(12): Phe, Trp or Tyr
  MOD_RES (14)..(14): Ile, Leu or Val
  MOD_RES (15)..(15): Variable amino acid
  MOD_RES (29)..(29): Variable amino acid
CXXXQFQCXSGXCXXQRWVCDGENDCEDXSDEANCAGSVPT

SEQ ID NO: 563 - protein, 39 aa, Artificial Sequence
  Description of Artificial Sequence: Synthetic polypeptide
CLPDQFQCGSGYCLPQAWVCDGENDCEDGSDETNCPART

SEQ ID NO: 564 - protein, 39 aa, Artificial Sequence
  Description of Artificial Sequence: Synthetic polypeptide
CLPDQFQCGSGYCLPQRWVCDGVDDCEDSSDEKGCTPHT

SEQ ID NO: 565 - protein, 41 aa, Artificial Sequence
  Description of Artificial Sequence: Synthetic polypeptide
CLSDQFQCGSGHCLPASWRCDGEDDCADSSDETSCTASEPT

SEQ ID NO: 566 - protein, 36 aa, Artificial Sequence
  Description of Artificial Sequence: Synthetic polypeptide
CPSSQFQCSSGWCIPEDWRCDGVPDCGDGSDEASDH

SEQ ID NO: 567 - protein, 44 aa, Artificial Sequence
  Description of Artificial Sequence: Synthetic polypeptide
CAPSQFQCGSGYCIPLTWVRDGVDDCEDGSDEEDCSQDPEFHKV

SEQ ID NO: 568 - protein, 43 aa, Artificial Sequence
  Description of Artificial Sequence: Synthetic polypeptide
CLPNQFTCDSGNCVPQALGCDGDNDCEDNSDESPALCAAPAHT

SEQ ID NO: 569 - protein, 43 aa, Artificial Sequence
  Description of Artificial Sequence: Synthetic polypeptide
CLPNEFTCDSGNCVPQALGCDGDNDCEDNSDESPALCAAPAHT

SEQ ID NO: 570 - protein, 41 aa, Artificial Sequence
  Description of Artificial Sequence: Synthetic polypeptide
CAPNQFQCGSGYCVPAAWVCDGENDCEDNSDESSALCQERT

SEQ ID NO: 571 - protein, 42 aa, Artificial Sequence
  Description of Artificial Sequence: Synthetic polypeptide
CLPDQFPCENGKCLPVNLVCDGDDDCPDGSDESEVCAGAVRT

SEQ ID NO: 572 - protein, 41 aa, Artificial Sequence
  Description of Artificial Sequence: Synthetic polypeptide
CPSSQFRCNNGHCLSVTLVCDGDNDCEDDSDETGCEGSGHT

SEQ ID NO: 573 - protein, 39 aa, Artificial Sequence
  Description of Artificial Sequence: Synthetic polypeptide
CQPGEFTCESGRCLPLRWLCDGEDDCVDSSDEASCQPPT

SEQ ID NO: 574 - protein, 39 aa, Artificial Sequence
  Description of Artificial Sequence: Synthetic polypeptide
CLSGEFTCENGNCLSLSLVCDGEDDCEDGSDEASCPPPT

SEQ ID NO: 575 - protein, 41 aa, Artificial Sequence
  Description of Artificial Sequence: Synthetic polypeptide
CPPDEFQCNSGSCLSQPLLCDGEDDCGDGSDEESCIAAEHT

SEQ ID NO: 576 - protein, 46 aa, Artificial Sequence
  Description of Artificial Sequence: Synthetic polypeptide
CQPGQFRCNNGHCLSQPLVCDGVPDCEDGSDEASCSAPASEPPGSL

SEQ ID NO: 577 - protein, 46 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(20): Variable amino acid
  MOD_RES (23)..(24): Variable amino acid
  MOD_RES (27)..(27): Variable amino acid
  MOD_RES (29)..(29): Variable amino acid
  MOD_RES (33)..(46): Variable amino acid
CXXXXFXCXXGXCXXXXXXXDGXXDCXDXSDEXXXXXXXXXXXXXX

SEQ ID NO: 578 - protein, 46 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (23)..(24): Variable amino acid
  MOD_RES (27)..(27): Variable amino acid
  MOD_RES (29)..(29): Variable amino acid
  MOD_RES (33)..(46): Variable amino acid
CXXXXFXCXXGXCXXXXXXCDGXXDCXDXSDEXXXXXXXXXXXXXX

SEQ ID NO: 579 - protein, 46 aa, Artificial Sequence; identical to SEQ ID NO: 578
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(46): Variable amino acid

SEQ ID NO: 580 - protein, 39 aa, Artificial Sequence
  Description of Artificial Sequence: Synthetic polypeptide
CLPDQFRCGNGQCIPLDWVCDGVNDCADNSDETGCPTRT

SEQ ID NO: 581 - protein, 39 aa, Artificial Sequence
  Description of Artificial Sequence: Synthetic polypeptide
CLPDQFRCGNGQCIPLDWVCDGVNDCGDNSDEAGCPTRT

SEQ ID NO: 582 - protein, 39 aa, Artificial Sequence
  Description of Artificial Sequence: Synthetic polypeptide
CLPDQFRCGNGQCIPLDWVCDGVNDCADNSDEAGCPPRT

SEQ ID NO: 583 - protein, 39 aa, Artificial Sequence
  Description of Artificial Sequence: Synthetic polypeptide
CLPDQFRCGNGQCIPLDWVCDGVNDCVDGSDEAGCPPRT

SEQ ID NO: 584 - protein, 39 aa, Artificial Sequence
  Description of Artificial Sequence: Synthetic polypeptide
CLPDQFRCGNGQCIPLDWVCDGVNDCEDSSDEAGCPPRT

SEQ ID NO: 585 - protein, 39 aa, Artificial Sequence
  Description of Artificial Sequence: Synthetic polypeptide
CLPDQFRCGNGQCIPLDWVCDGVNDCEDDSDEESCPPRT

SEQ ID NO: 586 - protein, 39 aa, Artificial Sequence
  Description of Artificial Sequence: Synthetic polypeptide
CLPDQFRCGNGQCIPLDWVCDGVNDCEDDSDEESCPPHT

SEQ ID NO: 587 - protein, 39 aa, Artificial Sequence
  Description of Artificial Sequence: Synthetic polypeptide
CLPDQFRCGNGQCIPLDWVCDGVNDCPDDSDEEGCPPRT

SEQ ID NO: 588 - protein, 39 aa, Artificial Sequence
  Description of Artificial Sequence: Synthetic polypeptide
CVPDQFPCGNGQCIPLDWVCDGVDDCEDNSDEKSCPPPR

SEQ ID NO: 589 - protein, 39 aa, Artificial Sequence
  Description of Artificial Sequence: Synthetic polypeptide
CLPGQFRCDNGQCIPAHWGCDGVNDCRDNSDEADCPQPT

SEQ ID NO: 590 - protein, 39 aa, Artificial Sequence
  Description of Artificial Sequence: Synthetic polypeptide
CQASEFPCDSGQCIPQPLGCDGDNDCADNSDEESCQPRT

SEQ ID NO: 591 - protein, 50 aa, Artificial Sequence
  Description of Artificial Sequence: Synthetic polypeptide
CEPGQFPCESGQCLPPPWVCDGVNDCADNSDEEDCGDSHILPFSTPGPST

SEQ ID NO: 592 - protein, 50 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (14)..(14): Ile, Leu or Val
  MOD_RES (16)..(19): Variable amino acid
  MOD_RES (23)..(23): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(50): Variable amino acid
CXXXXFXCXXGQCXPXXXXCDGXXDCXDXSDEXXCXXXXXXXXXXXXXXX

SEQ ID NO: 593 - protein, 50 aa, Artificial Sequence
  Description of Artificial Sequence: Synthetic polypeptide
  MOD_RES (2)..(2): Variable amino acid
  MOD_RES (4)..(4): Variable amino acid
  MOD_RES (7)..(7): Variable amino acid
  MOD_RES (9)..(10): Variable amino acid
  MOD_RES (14)..(14): Ile, Leu or Val
  MOD_RES (16)..(17): Variable amino acid
  MOD_RES (19)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(50): Variable amino acid
CXPXQFXCXXGQCXPXXWXCDGVXDCXDXSDEXXCXXXXXXXXXXXXXXX

SEQ ID NO: 594 - protein, 50 aa, Artificial Sequence
  Description of Artificial Sequence: Synthetic polypeptide
  MOD_RES (2)..(2): Ile, Leu or Val
  MOD_RES (4)..(4): Variable amino acid
  MOD_RES (7)..(7): Variable amino acid
  MOD_RES (9)..(9): Variable amino acid
  MOD_RES (16)..(17): Variable amino acid
  MOD_RES (19)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (37)..(50): Variable amino acid
CXPXQFXCXNGQCIPXXWXCDGVXDCXDXSDEXXCPXXXXXXXXXXXXXX

SEQ ID NO: 595 - protein, 50 aa, Artificial Sequence
  Description of Artificial Sequence: Synthetic polypeptide
  MOD_RES (2)..(2): Ile, Leu or Val
  MOD_RES (7)..(7): Variable amino acid
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (37)..(50): Variable amino acid
CXPDQFXCGNGQCIPLDWVCDGVXDCXDXSDEXXCPXXXXXXXXXXXXXX

SEQ ID NO: 596 - protein, 50 aa, Artificial Sequence
  Description of Artificial Sequence: Synthetic polypeptide
  MOD_RES (27)..(27): Variable amino acid
  MOD_RES (29)..(29): Variable amino acid
  MOD_RES (33)..(34): Variable amino acid
  MOD_RES (37)..(38): Variable amino acid
  MOD_RES (40)..(50): Variable amino acid
CLPDQFRCGNGQCIPLDWVCDGVNDCXDXSDEXXCPXXTXXXXXXXXXXX

SEQ ID NO: 597 - protein, 50 aa, Artificial Sequence
  Description of Artificial Sequence: Synthetic polypeptide
  MOD_RES (27)..(27): Variable amino acid
  MOD_RES (29)..(29): Variable amino acid
  MOD_RES (33)..(34): Variable amino acid
  MOD_RES (37)..(37): Variable amino acid
  MOD_RES (40)..(50): Variable amino acid
CLPDQFRCGNGQCIPLDWVCDGVNDCXDXSDEXXCPXRTXXXXXXXXXXX

SEQ ID NO: 598 - protein, 40 aa, Artificial Sequence
  Description of Artificial Sequence: Synthetic polypeptide
CLPSEFQCRDSKICLSADWLCDGVNDCADNSDEEGCPPPT

SEQ ID NO: 599 - protein, 40 aa, Artificial Sequence
  Description of Artificial Sequence: Synthetic polypeptide
CLPSEFQCRDSKICLSADWLCDGVNDCVDGSDEAGCPPRT

SEQ ID NO: 600 - protein, 39 aa, Artificial Sequence
  Description of Artificial Sequence: Synthetic polypeptide
CEANELRCSSGRCLSVHWLCDGVDDCEDSSDEAGCPPRT

SEQ ID NO: 601 - protein, 39 aa, Artificial Sequence
  Description of Artificial Sequence: Synthetic polypeptide
CPASQFPCSSGHCVPLNWVCDGVNDCVDGSDEAGCPPRT

SEQ ID NO: 602 - protein, 39 aa, Artificial Sequence
  Description of Artificial Sequence: Synthetic polypeptide
CESDQFQCDSGHCVPLNWVCDGVNDCVDGSDEAGCPPRT

SEQ ID NO: 603 - protein, 39 aa, Artificial Sequence
  Description of Artificial Sequence: Synthetic polypeptide
CPSDEFTCDSGRCVSLNWLCDGVNDCGDNSDEAGCPTRT

SEQ ID NO: 604 - protein, 39 aa, Artificial Sequence
  Description of Artificial Sequence: Synthetic polypeptide
CLSDEFTCDSGRCVSLNWLCDGVNDCGDNSDEAGCPTHT

SEQ ID NO: 605 - protein, 39 aa, Artificial Sequence
  Description of Artificial Sequence: Synthetic polypeptide
CPSSQFRCSSGRCVPADWLCDGVNDCADNSDETGCPTRT

SEQ ID NO: 606 - protein, 39 aa, Artificial Sequence
  Description of Artificial Sequence: Synthetic polypeptide
CPSSQFRCSSGRCVPADWLCDGVNDCADNSDETGCATRT

SEQ ID NO: 607 - protein, 39 aa, Artificial Sequence
  Description of Artificial Sequence: Synthetic polypeptide
CPSSQFRCSSGRCVPADWLCDGVNDCGDNSDEAGCPTRT

SEQ ID NO: 608 - protein, 39 aa, Artificial Sequence
  Description of Artificial Sequence: Synthetic polypeptide
CRADEFQCGSGRCVPADWLCDGVNDCADNSDETGCPTRT

SEQ ID NO: 609 - protein, 39 aa, Artificial Sequence
  Description of Artificial Sequence: Synthetic polypeptide
CVSSQFQCGNGHCVPAQWLCDGVNDCGDNSDEASCPPRT

SEQ ID NO: 610 - protein, 41 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (11)..(11): Variable amino acid that may or may not be present
  MOD_RES (12)..(14): Variable amino acid
  MOD_RES (16)..(16): Ile, Leu or Val
  MOD_RES (17)..(19): Variable amino acid
  MOD_RES (21)..(21): Ile, Leu or Val
  MOD_RES (26)..(26): Asp or Asn
  MOD_RES (29)..(29): Variable amino acid
  MOD_RES (31)..(31): Variable amino acid
  MOD_RES (35)..(36): Variable amino acid
  MOD_RES (38)..(40): Variable amino acid
CXXXXXXCXXXXXXCXXXXWXCDGVXDCXDXSDEXXCXXXT

SEQ ID NO: 611 - protein, 41 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (11)..(11): Variable amino acid that may or may not be present
  MOD_RES (13)..(14): Variable amino acid
  MOD_RES (16)..(16): Ile, Leu or Val
  MOD_RES (17)..(19): Variable amino acid
  MOD_RES (21)..(21): Ile, Leu or Val
  MOD_RES (26)..(26): Asp or Asn
  MOD_RES (29)..(29): Variable amino acid
  MOD_RES (31)..(31): Variable amino acid
  MOD_RES (35)..(35): Variable amino acid
  MOD_RES (38)..(40): Variable amino acid
CXXXXXXCXXXSXXCXXXXWXCDGVXDCXDXSDEXGCXXXT

SEQ ID NO: 612 - protein, 41 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (11)..(11): Variable amino acid that may or may not be present
  MOD_RES (13)..(14): Variable amino acid
  MOD_RES (16)..(16): Ile, Leu or Val
  MOD_RES (17)..(18): Variable amino acid
  MOD_RES (19)..(19): Asp or Asn
  MOD_RES (21)..(21): Ile, Leu or Val
  MOD_RES (29)..(29): Variable amino acid
  MOD_RES (31)..(31): Variable amino acid
  MOD_RES (35)..(35): Variable amino acid
  MOD_RES (38)..(40): Variable amino acid
CXXXXFXCXXXSXXCXXXXWXCDGVNDCXDXSDEXGCXXXT

SEQ ID NO: 613 - protein, 41 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (11)..(11): Variable amino acid that may or may not be present
  MOD_RES (13)..(14): Variable amino acid
  MOD_RES (16)..(16): Ile, Leu or Val
  MOD_RES (17)..(18): Variable amino acid
  MOD_RES (19)..(19): Asp or Asn
  MOD_RES (21)..(21): Ile, Leu or Val
  MOD_RES (29)..(29): Variable amino acid
  MOD_RES (31)..(31): Variable amino acid
  MOD_RES (35)..(35): Variable amino acid
  MOD_RES (39)..(40): Variable amino acid
CXXXXFXCXXXSXXCXXXXWXCDGVNDCXDXSDEXGCPXXT

SEQ ID NO: 614 - protein, 41 aa, Artificial Sequence
  Description of Artificial Sequence: Synthetic polypeptide
  MOD_RES (2)..(2): Variable amino acid
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(10): Variable amino acid
  MOD_RES (11)..(11): Variable amino acid that may or may not be present
  MOD_RES (14)..(14): Variable amino acid
  MOD_RES (17)..(18): Variable amino acid
  MOD_RES (19)..(19): Asp or Asn
  MOD_RES (21)..(21): Ile, Leu or Val
  MOD_RES (29)..(29): Variable amino acid
  MOD_RES (31)..(31): Variable amino acid
  MOD_RES (35)..(35): Ala, Ser or Thr
  MOD_RES (38)..(40): Variable amino acid
CXXXXFXCXXXSGXCVXXXWXCDGVNDCXDXSDEXGCXXXT

SEQ ID NO: 615 - protein, 41 aa, Artificial Sequence
  Description of Artificial Sequence: Synthetic polypeptide
  MOD_RES (2)..(2): Variable amino acid
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(10): Variable amino acid
  MOD_RES (11)..(11): Variable amino acid that may or may not be present
  MOD_RES (14)..(14): Variable amino acid
  MOD_RES (17)..(18): Variable amino acid
  MOD_RES (19)..(19): Asp or Asn
  MOD_RES (21)..(21): Ile, Leu or Val
  MOD_RES (29)..(29): Variable amino acid
  MOD_RES (31)..(31): Variable amino acid
  MOD_RES (35)..(35): Ala, Ser or Thr
  MOD_RES (39)..(40): Variable amino acid
CXXXXFXCXXXSGXCVXXXWXCDGVNDCXDXSDEXGCPXXT

SEQ ID NO: 616 - protein, 39 aa, Artificial Sequence
  Description of Artificial Sequence: Synthetic polypeptide
CLSSEFTCGNGNCIPRPWVCDGDNDCVDDSDEKGCPEPT

SEQ ID NO: 617 - protein, 40 aa, Artificial Sequence
  Description of Artificial Sequence: Synthetic polypeptide
CLANQFKCDNGRCIPQTWVCDGDNDCLDGSDEPVHCAKRT

SEQ ID NO: 618 - protein, 40 aa, Artificial Sequence
  Description of Artificial Sequence: Synthetic polypeptide
CLANQFKCDNGRFIPQTWVCDGDNDCLDGSDEPVHCAKRT

SEQ ID NO: 619 - protein, 40 aa, Artificial Sequence; identical to SEQ ID NO: 617
  Description of Artificial Sequence: Synthetic polypeptide

SEQ ID NO: 620 - protein, 40 aa, Artificial Sequence
  Description of Artificial Sequence: Synthetic polypeptide
CLANQFKCDNGRCIPQTWVCDGDNDCLDGSDEPVRCAKRT

SEQ ID NO: 621 - protein, 40 aa, Artificial Sequence
  Description of Artificial Sequence: Synthetic polypeptide
CLANQFKCDNGRCIPQTWVCDGDNDCLDGSDEPVHCAERT

SEQ ID NO: 622 - protein, 40 aa, Artificial Sequence
  Description of Artificial Sequence: Synthetic polypeptide
CLSSEFTCGNGNCIPQTWVCDGDNDCLDGSDEPVHCAKRT

SEQ ID NO: 623 - protein, 41 aa, Artificial Sequence
  Description of Artificial Sequence: Synthetic polypeptide
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(9): Variable amino acid
  MOD_RES (12)..(13): Variable amino acid
  MOD_RES (16)..(16): Lys, Gln or Arg
  MOD_RES (17)..(17): Variable amino acid
  MOD_RES (27)..(27): Ile, Leu or Val
  MOD_RES (29)..(29): Variable amino acid
  MOD_RES (33)..(33): Variable amino acid
  MOD_RES (34)..(34): Variable amino acid that may or may not be present
  MOD_RES (35)..(36): Variable amino acid
  MOD_RES (38)..(38): Variable amino acid
  MOD_RES (39)..(39): Glu, Lys or Gln
  MOD_RES (40)..(40): Variable amino acid
CLXXXFXCXNGXXIPXXWVCDGDNDCXDXSDEXXXXCXXXT

SEQ ID NO: 624 - protein, 41 aa, Artificial Sequence
  Description of Artificial Sequence: Synthetic polypeptide
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(9): Variable amino acid
  MOD_RES (12)..(12): Variable amino acid
  MOD_RES (16)..(16): Lys, Gln or Arg
  MOD_RES (17)..(17): Variable amino acid
  MOD_RES (27)..(27): Ile, Leu or Val
  MOD_RES (29)..(29): Variable amino acid
  MOD_RES (33)..(33): Variable amino acid
  MOD_RES (34)..(34): Variable amino acid that may or may not be present
  MOD_RES (35)..(36): Variable amino acid
  MOD_RES (38)..(38): Variable amino acid
  MOD_RES (39)..(39): Glu, Lys or Gln
  MOD_RES (40)..(40): Variable amino acid
CLXXXFXCXNGXCIPXXWVCDGDNDCXDXSDEXXXXCXXXT

SEQ ID NO: 625 - protein, 41 aa, Artificial Sequence
  Description of Artificial Sequence: Synthetic polypeptide
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(9): Variable amino acid
  MOD_RES (12)..(13): Variable amino acid
  MOD_RES (33)..(33): Variable amino acid
  MOD_RES (34)..(34): Variable amino acid that may or may not be present
  MOD_RES (36)..(36): Variable amino acid
  MOD_RES (39)..(39): Glu, Lys or Gln
CLXXXFXCXNGXXIPQTWVCDGDNDCLDGSDEXXVXCAXRT

SEQ ID NO: 626 - protein, 41 aa, Artificial Sequence
  Description of Artificial Sequence: Synthetic polypeptide
  MOD_RES (13)..(13): Variable amino acid
  MOD_RES (33)..(33): Variable amino acid
  MOD_RES (34)..(34): Variable amino acid that may or may not be present
  MOD_RES (36)..(36): Variable amino acid
  MOD_RES (39)..(39): Glu, Lys or Gln
CLANQFKCDNGRXIPQTWVCDGDNDCLDGSDEXXVXCAXRT

SEQ ID NO: 627 - protein, 82 aa, Artificial Sequence
  Description of Artificial Sequence: Synthetic polypeptide
CLPNQFQCRSGQCIPRPWVCDGDNDCGDDSDEANCKAPVHTCLPSQFQCGSGYCISQRWVCDGENDCEDSSDEANCGRTEPT

SEQ ID NO: 628 - protein, 80 aa, Artificial Sequence
  Description of Artificial Sequence: Synthetic polypeptide
CLSSEFTCGNGNCIPRPWVCDGDNDCVDDSDEKGCPEPTCLPSQFQCGSGYCISQRWVCDGENDCEDSSDEANCAGSVPT

SEQ ID NO: 629 - protein, 91 aa, Artificial Sequence
  Description of Artificial Sequence: Synthetic polypeptide
CLSSQFQCSNGNCIPAAWLCDSDNDCGDDSDETSCPAPTCPSSQFQCSSGWCIPEDWRCDGVPDCGDGSDEASDHCGDSHILPFSTPGPST

SEQ ID NO: 630 - protein, 82 aa, Artificial Sequence
  Description of Artificial Sequence: Synthetic polypeptide
CLASEFQCRNGSCIPLQWLCDGDNDCGDDSDEENCATTERTCLPSQFQCGSGYCISQRWVCDGENDCEDSSDEANCAGSVPT

SEQ ID NO: 631 - protein, 91 aa, Artificial Sequence
  Description of Artificial Sequence: Synthetic polypeptide
CLSSEFTCGNGNCIPRPWVCDGDNDCVDDSDEKGCPEPTCPSSQFQCSSGWCIPEDWRCDGVPDCGDGSDEASDHCGDSHILPFSTPGPST

SEQ ID NO: 632 - protein, 83 aa, Artificial Sequence
  Description of Artificial Sequence: Synthetic polypeptide
CGASQFQCHNTSICIPRPFVCDGDNDCGDDSDEADCKTSGHTCLPSQFQCGSGYCISQRWVCDGENDCEDSSDEANCAGSVPT

SEQ ID NO: 633 - protein, 78 aa, Artificial Sequence
  Description of Artificial Sequence: Synthetic polypeptide
CLSSEFTCGNGNCIPRPWVCDGDNDCVDDSDEKGCPEPTCLPDQFQCGSGYCLPQRWVCDGVDDCEDSSDEKGCTPHT

SEQ ID NO: 634 - protein, 78 aa, Artificial Sequence
  Description of Artificial Sequence: Synthetic polypeptide
CPSSQFQCGSGYCISPAWVCDGVNDCEDGSDEKSCAPHTCLPDQFQCGSGYCLPQAWVCDGENDCEDGSDETNCPART

SEQ ID NO: 635 - protein, 78 aa, Artificial Sequence
  Description of Artificial Sequence: Synthetic polypeptide
CAPSQFTCGNGNCVPRPWLCDGDNDCEDDSDETSCPPHTCLPDQFQCGSGYCLPQAWVCDGENDCEDGSDETNCPART

SEQ ID NO: 636 - protein, 78 aa, Artificial Sequence
  Description of Artificial Sequence: Synthetic polypeptide
  MOD_RES (37)..(37): Variable amino acid
CAPSQFTCGNGNCVPRPWLCDGDNDCEDDSDETSCPXHTCLPDQFQCGSGYCLPQAWVCDGENDCEDGSDETNCPART

SEQ ID NO: 637 - protein, 82 aa, Artificial Sequence
  Description of Artificial Sequence: Synthetic polypeptide
CLPSQFQCGSGYCISQRWVCDGENDCEDSSDEANCAGSVPTCRPGQFQCGSGYCIPRPWRCDGDNDCEDDSDEKGCARSEPT

SEQ ID NO: 638 - protein, 80 aa, Artificial Sequence
  Description of Artificial Sequence: Synthetic polypeptide
CLPSQFQCRNGRCIPLPWLCDGDNDCEDDSDETNCTPRTCAPSQFQCGSGYCIPLTWVCDGVDDCEDGSDEEDCETAAPT

SEQ ID NO: 639 - protein, 80 aa, Artificial Sequence
  Description of Artificial Sequence: Synthetic polypeptide
CLPSQFQCGSGYCISQRWVCDGENDCEDSSDEANCAGSVPTCRASQFQCGSGYCIPRPWLCDGVNDCEDGSDEADCQTRT

SEQ ID NO: 640 - protein, 80 aa, Artificial Sequence
  Description of Artificial Sequence: Synthetic polypeptide
CVPSQFQCGSGYCISQRWVCDGENDCEDSSDEANCAGSVPTCLPDQFQCGSGYCLPQAWVCDGENDCEDGSDETNCPART

SEQ ID NO: 641 - protein, 80 aa, Artificial Sequence
  Description of Artificial Sequence: Synthetic polypeptide
CLPSQFQCRNGRCIPLPWLCDGDNDCEDDSDETNCTPRTCAPNQFQCGSGYCVPAAWVCDGENDCEDNSDESSALCQERT

SEQ ID NO: 642 - protein, 78 aa, Artificial Sequence
  Description of Artificial Sequence: Synthetic polypeptide
  MOD_RES (37)..(37): Variable amino acid
CAPSQFTCGNGNCIPRPWLCDGDNDCEDDSDETSCPXPTCLPDQFQCGSGYCLPQAWVCDGENDCEDGSDETNCPART

SEQ ID NO: 643 - protein, 80 aa, Artificial Sequence
  Description of Artificial Sequence: Synthetic polypeptide
CLSSEFTCGNGNCIPRPWVCDGDNDCVDDSDEKGCPEPTCVPSQFQCGSGYCISQRWVCDGENDCEDSSDEANCAGSVPT

SEQ ID NO: 644 - protein, 82 aa, Artificial Sequence
  Description of Artificial Sequence: Synthetic polypeptide
CAPNQFQCGSGYCVPAAWVCDGENDCEDNSDESSALCQERTCLPSQFQCGSGYCISQRWVCDGENDCEDSSDEANCAGSVPT

SEQ ID NO: 645 - protein, 78 aa, Artificial Sequence
  Description of Artificial Sequence: Synthetic polypeptide
CGANEFQCGSGYCLPVGWVCDGENDCEDNSDEKGCPPHTCLPNQFQCRNGRCIPLPWLCDGDNDCEDDSDATNCTPRT

SEQ ID NO: 646 - protein, 82 aa, Artificial Sequence
  Description of Artificial Sequence: Synthetic polypeptide
CAPNQFQCGSGYCVPAAWVCDGENDCEDNSDESSALCQERTCVPSQFQCGSGYCISQRWVCDGENDCEDSSDEANCAGSVPT

SEQ ID NO: 647 - protein, 80 aa, Artificial Sequence
  Description of Artificial Sequence: Synthetic polypeptide
CLPDQFQCGSGYCLPQRWVCDGVDDCEDSSDEANCAGSVPTCLPDQFQCGSGYCLPQAWVCDGENDCEDGSDETNCPART

SEQ ID NO: 648 - protein, 82 aa, Artificial Sequence
  Description of Artificial Sequence: Synthetic polypeptide
CAPSQFQCGSGYCIPLTWVCDGVDDCEDGSDEEDCETAAPTCLPSQFQCGSGYCISQRWVCDGENDCEDSSDEANCAGSVPT

SEQ ID NO: 649 - protein, 80 aa, Artificial Sequence
  Description of Artificial Sequence: Synthetic polypeptide
CLPSQFQCRNGRCIPLPWLCDGDNDCEDDSDETNCTPRTCLPSQFQCGSGYCISQRWVCDGENDCEDSSDEANCAGSVPT

SEQ ID NO: 650 - protein, 80 aa, Artificial Sequence
  Description of Artificial Sequence: Synthetic polypeptide
CAPSQFTCGNGNCVPRPWLCDGDNDCEDDSDETSCPPHTCAPNQFQCGSGYCVPAAWVCDGENDCEDNSDESSALCQERT

SEQ ID NO: 651 - protein, 81 aa, Artificial Sequence
  Description of Artificial Sequence: Synthetic polypeptide
CLPSEFQCHSTSICVPRQWLCDGDNDCGDDSDEKGCETHTCVPSQFQCGSGYCISQRWVCDGENDCEDSSDEANCAGSVPT

SEQ ID NO: 652 - protein, 78 aa, Artificial Sequence
  Description of Artificial Sequence: Synthetic polypeptide
CPPDQFQCGSGYCLPQAWVCDGENDCEDGSDETNCPARTCLSSEFTCGNGNCIPRPWVCDGDNDCVDDSDEKGCPEPT

SEQ ID NO: 653 - protein, 80 aa, Artificial Sequence
  Description of Artificial Sequence: Synthetic polypeptide
CAPSQFTCGNGNCVPRPWLCDGDNDCEDDSDETSCPPHTCAPSQFQCGSGYCIPLTWVCDGVDDCEDGSDEEDCETAAPT

SEQ ID NO: 654 - protein, 78 aa, Artificial Sequence
  Description of Artificial Sequence: Synthetic polypeptide
CLPSQFQCRNGRCIPLPWLCDGDNDCEDDSDETNCTPRTCLPDQFQCGSGYCLPQAWVCDGENDCEDGSDETNCPART

SEQ ID NO: 655 - protein, 78 aa, Artificial Sequence; identical to SEQ ID NO: 633
  Description of Artificial Sequence: Synthetic polypeptide

SEQ ID NO: 656 - protein, 80 aa, Artificial Sequence
  Description of Artificial Sequence: Synthetic polypeptide
CAPSQFQCGSGYCIPLTWVCDGVDDCEDGSDEEDCETAAPTCLPDQFQCGSGYCLPQAWVCDGENDCEDGSDETNCPART

SEQ ID NO: 657 - protein, 87 aa, Artificial Sequence
  Description of Artificial Sequence: Synthetic polypeptide
CAPNQFQCGSGYCVPAAWVCDGENDCEDNSDESSALCQERTCLSSQFQCDNGNCVPQQWVCDGDNDCLDDSDETSCSAPASEPPGSL

SEQ ID NO: 658 - protein, 80 aa, Artificial Sequence
  Description of Artificial Sequence: Synthetic polypeptide
  MOD_RES (73)..(73): Variable amino acid
  MOD_RES (78)..(78): Variable amino acid
CLSSEFTCGHGICIPRPWVCDRDNDCMYHSHEISCPEPTCLPDQFQCGSVYCLPERLVCDCLNDCEDSSDEAXCAGSXPT

SEQ ID NO: 659 - protein, 80 aa, Artificial Sequence
  Description of Artificial Sequence: Synthetic polypeptide
CLPSQFQCRNGRCIPLPWLCDGDNDCEDDSDETNCTPRTCVPSQFQCGSGYCISQRWVCDGENDCEDSSDEANCAGSVPT

SEQ ID NO: 660 - protein, 88 aa, Artificial Sequence
  Description of Artificial Sequence: Synthetic polypeptide
  MOD_RES (65)..(65): Variable amino acid
CVPSQFQCGSGYCISQRWVCDGENDCEDSSDEANCAGSVPTCGWWGSSEFRCATYPHGRCIPSSXVCDGEDDCGDGSDEHEVFCGGGG

SEQ ID NO: 661 - protein, 81 aa, Artificial Sequence
  Description of Artificial Sequence: Synthetic polypeptide
CAPSQFQCGSGYCIPLTWVCDGVDDCEDGSDEEDCETAAPTCLPSEFQCHSTSICVPRQWLCDGDNDCGDDSDEKGCETHT

SEQ ID NO: 662 - protein, 80 aa, Artificial Sequence
  Description of Artificial Sequence: Synthetic polypeptide
CVPSQFQCGSGYCISQRWVCDGENDCEDSSDEANCAGSVPTCLSSEFTCGNGNCIPRPWVCDGDNDCVDDSDEKGCPEPT

SEQ ID NO: 663 - protein, 79 aa, Artificial Sequence
  Description of Artificial Sequence: Synthetic polypeptide
CLPSEFQCHSTSICVPRQWLCDGDNDCGDDSDEKGCETHTCLASQFTCRNGNCIPEPWVCDGDNDCVDDSDEESCPPHT

SEQ ID NO: 664 - protein, 61 aa, Artificial Sequence
  Description of Artificial Sequence: Synthetic polypeptide
CEADQFQCGSGYCLPRHWVCDGDNDCEDDSDETDCGRPGPGATSAPAVSGGSGGSGGSCGS

SEQ ID NO: 665 - protein, 80 aa, Artificial Sequence
  Description of Artificial Sequence: Synthetic polypeptide
CRASQFQCGSGYCIPRPWLCDGVNDCEDGSDEADCQTRTCVPSQFQCGSGYCISQRWVCDGENDCEDSSDEANCAGSVPT

SEQ ID NO: 666 - protein, 80 aa, Artificial Sequence
  Description of Artificial Sequence: Synthetic polypeptide
CAPNQFQCGSGYCVPAAWVCDGENDCEDNSDESLAHCQAHTCVSSEFRCSSGQCIPPPWRCDGVDDCADNSDEAGCTPPT

SEQ ID NO: 667 - protein, 80 aa, Artificial Sequence
  Description of Artificial Sequence: Synthetic polypeptide
  MOD_RES (70)..(70): Variable amino acid
CQPGQFPCGSGSCVSERLLCDGVDDCADGSDEAGCPPRTCVPSQFQCGSGYCISQRWVCDGENDCEDSSXEANCAGSVPT

SEQ ID NO: 668 - protein, 82 aa, Artificial Sequence
  Description of Artificial Sequence: Synthetic polypeptide
  MOD_RES (78)..(78): Variable amino acid
CHATAQFECSSGQCISLDWLCDGVNDCADGSDESQHCPPRTCVPSQFQCGSGYCISQRWVCDGENDCEDSSDEANCAXSVPT

SEQ ID NO: 669 - protein, 81 aa, Artificial Sequence
  Description of Artificial Sequence: Synthetic polypeptide
CEASQFPCRNSERCVPPHLLCDGVNDCADGSDEIGCPPHTCVPSQFQCGSGYCISQRWVCDGENDCEDSSDEANCAGSVPT

SEQ ID NO: 670 - protein, 81 aa, Artificial Sequence
  Description of Artificial Sequence: Synthetic polypeptide
CPSNQFQCRNNGTCIPLPWLCDGVDDCGDDSDETSCTEPTCVPSQFQCGSGYCISQRWVCDGENDCEDSSDEANCAGSVPT

SEQ ID NO: 671 - protein, 82 aa, Artificial Sequence
  Description of Artificial Sequence: Synthetic polypeptide
CQSSEFTCSSGRCLSAGWLCDGVNDCRDDSDEESCTAPVPTCVPSQFQCGSGYCISQRWVCDGENDCEDSSDEANCAGSVPT

SEQ ID NO: 672 - protein, 81 aa, Artificial Sequence
  Description of Artificial Sequence: Synthetic polypeptide
CQPGQFQCHDYGRCVSQNWLCDGDPDCLDSSDEANCQPPTCVPSQFQCGSGYCISQRWVCDGENDCEDSSDEANCAGSVPT

SEQ ID NO: 673 - protein, 80 aa, Artificial Sequence
  Description of Artificial Sequence: Synthetic polypeptide
CPAGQFQCRTGRCIPLALLCDGENDCQDGSDEAGCPTPTCVPSQFQCGSGYCISQRWVCDGENDCEDSSDEANCAGSVPT

SEQ ID NO: 674 - protein, 80 aa, Artificial Sequence
  Description of Artificial Sequence: Synthetic polypeptide
CGAGEFPCDNGRCVPAALLCDGDDDCGDNSDEKDCAQPTCVPSQFQCGSGYCISQRWVCDGENDCEDSSDEANCAGSVPT

SEQ ID NO: 675 - protein, 81 aa, Artificial Sequence
  Description of Artificial Sequence: Synthetic polypeptide
CRSSEFRCDSGHCLPLPWVCDGDDDCEDGSDEAQDCEPRTCVPSQFQCGSGYCISQRWVCDGENDCEDSSDEANCAGSVPT

SEQ ID NO: 676 - protein, 82 aa, Artificial Sequence
  Description of Artificial Sequence: Synthetic polypeptide
CRSNQFQCGSGYCIPVKWLCDGENDCEDGSDESLAHCQAHTCVASQFRCDNGRCLSEPLGCDGVNDCPDNSDEEDCTTAEHT

SEQ ID NO: 677 - protein, 83 aa, Artificial Sequence
  Description of Artificial Sequence: Synthetic polypeptide
CRADQCQCNSGHCLSRNLRCDGEDDCADNSDEKSCSQDPEFHKVCLPDQFQCGSGYCLPQRWVCDGVDDCEDSSDEKGCTPHT

SEQ ID NO: 678 - protein, 82 aa, Artificial Sequence
  Description of Artificial Sequence: Synthetic polypeptide
CLPSQFQCGSGYCISQRWVCDGENDCEDSSDEANCAGSVPTCRSSQFQCGNGRCISVHWVCDGDDDCEDSSDESSAHCKPRT

SEQ ID NO: 679 - protein, 80 aa, Artificial Sequence
  Description of Artificial Sequence: Synthetic polypeptide
CPSNEFRCNNGHCIPRAWRCDGDNDCGDSSDETDCTQRTCRSNQFQCGSGYCISQRWVCDGENDCEDSSDEANCAGSVPT

SEQ ID NO: 680 - protein, 82 aa, Artificial Sequence
  Description of Artificial Sequence: Synthetic polypeptide
CPADEFPCKNGKCLPLPWVCDGDNDCADNSDETDCTATAPTCRSNQFQCGSGYCISQRWVCDGENDCEDSSDEANCAGSVPT

SEQ ID NO: 681 - protein, 80 aa, Artificial Sequence
  Description of Artificial Sequence: Synthetic polypeptide
CGSDEFLCNNGKCIPPTWGCDGVNDCQDNSDEAPALCPPPTCRSNQFQCGSGYCIPQRWVCDGVDDCEDSSDEKGCTPHT

SEQ ID NO: 682 - protein, 82 aa, Artificial Sequence
  Description of Artificial Sequence: Synthetic polypeptide
  MOD_RES (60)..(60): Variable amino acid
CAPNQFQCGSGYCVPAAWVCDGENDCEDSSDEANCAGSVPTCRSGQFQCGSGYCISQRWXCDGENDCEDSSDEANCAGSVPT

SEQ ID NO: 683 - protein, 87 aa, Artificial Sequence
  Description of Artificial Sequence: Synthetic polypeptide
CLPGQFQCGSGYCISQRWVCDGENDCEDSSDEANCAGSVPTCRPSQFPCSNGQCVPQTWVCDGVNDCQDDSDETDCSAPASEPPGSL

SEQ ID NO: 684 - protein, 80 aa, Artificial Sequence
  Description of Artificial Sequence: Synthetic polypeptide
CLPSQFQCGSGYCISQRWVCDGENDCEDSSDEANCAGSVPTCRPSEYPCGNGRCVPQPLRCDGVNDCEDSSDEANCTPHT

SEQ ID NO: 685 - protein, 80 aa, Artificial Sequence
  Description of Artificial Sequence: Synthetic polypeptide
  MOD_RES (11)..(11): Variable amino acid
CRSNQFQCGSXYCIPVKWLCDGENDCEDGSDEADCAGSVPTCRPDQFPCDNGNCIPGPWGCDGVNDCLDSSDETDCTPPT

SEQ ID NO: 686 - protein, 79 aa, Artificial Sequence
  Description of Artificial Sequence: Synthetic polypeptide
CPSSQFKCNNGSCVPQDWLCDGVNDCVDGSDEPAVCQQRTCRASQFQCGSGYCIPRPWLCDGVNDCEDGSDEADCQTRA

SEQ ID NO: 687 - protein, 78 aa, Artificial Sequence
  Description of Artificial Sequence: Synthetic polypeptide
CASGEFRCGNGRCVPQRWLCDGVPDCEDNSDETDCQPPTCRASQFQCGSGYCIPRPWLCDGVDDCEDSSDEKGCTPHT

SEQ ID NO: 688 - protein, 80 aa, Artificial Sequence
  Description of Artificial Sequence: Synthetic polypeptide
CLPSQFQCGSGYCIPQRWVCDGENDCEDSSDEANCAGSVPTCQSSEFPCSSGHCLPLALGCDGEDDCADNSDEESCEPRT

SEQ ID NO: 689 - protein, 82 aa, Artificial Sequence
  Description of Artificial Sequence: Synthetic polypeptide
CRASQFQCGSGYCIPRPWLCDGVNDCEDSSDEANCAGSVPTCQPSQFRCRSGHCISGALGCDGEPDCGDGSDETGCRASAHT

SEQ ID NO: 690 - protein, 83 aa, Artificial Sequence
  Description of Artificial Sequence: Synthetic polypeptide
  MOD_RES (64)..(64): Variable amino acid
  MOD_RES (66)..(66): Variable amino acid
  MOD_RES (73)..(73): Variable amino acid
CLPSQFQCGSGYCISQRWVCDGENDCEDSSDEANCAGSVPTCQPDQFRCGSGPLRSTALACDGXKXLSGQLGXKKAVEPPDRT

SEQ ID NO: 691 - protein, 80 aa, Artificial Sequence
  Description of Artificial Sequence: Synthetic polypeptide
  MOD_RES (72)..(72): Variable amino acid
CLPSQFQCGSGYCISQRWVCDGENDCEDSSDEANCAGSVPTCQAGEFRCGNGRCLPPDWRCDGVDDCGDGSXEASCKTPT

SEQ ID NO: 692 - protein, 81 aa, Artificial Sequence
  Description of Artificial Sequence: Synthetic polypeptide
CQSDEFTCRDSNKCVSRDWLCDGEDDCPDGSDETSCAGSERTCPSSQFQCSSGWCIPEDWRCDGVPDCGDGSDEASCPPHT

SEQ ID NO: 693 - protein, 89 aa, Artificial Sequence
  Description of Artificial Sequence: Synthetic polypeptide
CVPSQFQCGSGYCISQRWVCDGENDCEDSSDEANCAGSVPTCPSNEFPCESGHCVPLTWRCDGEDDCPDSSDEANCGRPGPGATSVPAA

SEQ ID NO: 694 - protein, 79 aa, Artificial Sequence
  Description of Artificial Sequence: Synthetic polypeptide
  MOD_RES (70)..(70): Variable amino acid
CRSNQFQCGSGYCLPQAWVCDGENDCEDGSDETNCPARTCPSGQFRCDNGKCLSEAWVCDGVDDCRDGSXESEHCAPPT

SEQ ID NO: 695 - protein, 88 aa, Artificial Sequence
  Description of Artificial Sequence: Synthetic polypeptide
CRSNQFQCGSGYCISQRWVCDGENDCEDSSDEANCAGSVPTCPSGQFQCRGTGKCIPQPWVCDGDNDCQDDSDEKDCSAPASEPPGSL

SEQ ID NO: 696 - protein, 80 aa, Artificial Sequence
  Description of Artificial Sequence: Synthetic polypeptide
CLPSQFQCGSGYCISQRWVCDGENDCEDSSDEANCAGSVPTCPSGEFRCGNGSCLPAGWVCDGVDDCVDGSDEKGCQTPT

SEQ ID NO: 697 - protein, 80 aa, Artificial Sequence
  Description of Artificial Sequence: Synthetic polypeptide
  MOD_RES (64)..(64): Variable amino acid
CVPSQFQCGSGYCISQRWVCDGENDCEDGSDEANCAGSVPTCPSDEFRCRNGRCIPRAWRCDGXNDCADNSDEEDCTEHT

SEQ ID NO: 698 - protein, 80 aa, Artificial Sequence
  Description of Artificial Sequence: Synthetic polypeptide
CVPSQFQCGSGYCISQRWVCDGENDCEDGSDEANCAGSVPTCPSDEFRCRNGRCIPRAWRCDGVNDCADNSDEEDCTEHT

SEQ ID NO: 699 - protein, 79 aa, Artificial Sequence
  Description of Artificial Sequence: Synthetic polypeptide
  MOD_RES (37)..(37): Variable amino acid
CRSNQFQCGSGYCIPVKWLCDGENDCEDSSDEESCPXRTCPPSEFRCKGSGKCVPQHWLCDGVNDCEDDSDEKSCPPPT

SEQ ID NO: 700 - protein, 79 aa, Artificial Sequence
  Description of Artificial Sequence: Synthetic polypeptide
CRSNQFQCGSGYCIPVKWLCDGENDCEDSSDEESCPARTCPPSEFRCKGSGKCVPQHWLCDGVNDCEDDSDEKSCPPPT

SEQ ID NO: 701 - protein, 82 aa, Artificial Sequence
  Description of Artificial Sequence: Synthetic polypeptide
  MOD_RES (72)..(72): Variable amino acid
CLSSEFQCGSGYCISQRWVCDGENDCEDSSDEANCAGSVPTCPADEFRCSSGRCVPATWLCDGVDDCEDSSXESLETCTPHT

SEQ ID NO: 702 - protein, 85 aa, Artificial Sequence
  Description of Artificial Sequence: Synthetic polypeptide
  MOD_RES (61)..(61): Variable amino acid
CRSNQFQCGSGYCIPVKWLCDGENDCEDGSDEADCQTRTCLSSEFQCSNGQCVSQRLLCDXVDDCLDDSDEEDCSAPASEPPGSL

SEQ ID NO: 703 - protein, 80 aa, Artificial Sequence
  Description of Artificial Sequence: Synthetic polypeptide
  MOD_RES (50)..(50): Variable amino acid
  MOD_RES (61)..(61): Variable amino acid
CQANQFRCNNGRCLSPAWLCDGVDDCPNGSDEEGCPPHTCLSSEFQCGSXYCISQRWVCDXENDCEDSSDEANCAGSVPT

SEQ ID NO: 704 - protein, 80 aa, Artificial Sequence
  Description of Artificial Sequence: Synthetic polypeptide
CESGEFTCGSGQCLPATWRCDGDNDCADDSDETNCPQPTCLSSEFQCGSGYCISQRWVCDGENDCEDSSDEANCAGSVPT

SEQ ID NO: 705 - protein, 87 aa, Artificial Sequence
  Description of Artificial Sequence: Synthetic polypeptide
  MOD_RES (69)..(69): Variable amino acid
CPPGQFRCRSGNCLPQTWVCDGDDDCEDDSDESPALCSQDPEFHKVCLPSQFQCGSVYCISQRWVRDGXNDCEDSSDEANCAGSVPT

SEQ ID NO: 706 - protein, 79 aa, Artificial Sequence
  Description of Artificial Sequence: Synthetic polypeptide
CQSGQFPCGNGNCIPRPLRCDGVDDCPDGSDEPPECPQPTCLPSQFQCGSGYCISRRWVCDGENDCEDSSDEKGCTPHT

SEQ ID NO: 707 - protein, 81 aa, Artificial Sequence
  Description of Artificial Sequence: Synthetic polypeptide
  MOD_RES (62)..(62): Variable amino acid
CQPDEFTCHDKNRCISLALLCDGVNDCEDDSDEEGCAPRTCLPSQFQCGSGYCISQRWVCDXENDCEDSSDEANCAGSVPT

SEQ ID NO: 708 - protein, 80 aa, Artificial Sequence
  Description of Artificial Sequence: Synthetic polypeptide
  MOD_RES (61)..(61): Variable amino acid
  MOD_RES (80)..(80): Variable amino acid
CVSSQFKCSNGRCLPLGWLCDGVDDCADGSDEKNCPPPTCLPSQFQCGSGYCISQRWVCDXENDCEDSSDEADCAGSVPX

SEQ ID NO: 709 - protein, 82 aa, Artificial Sequence
  Description of Artificial Sequence: Synthetic polypeptide
  MOD_RES (72)..(73): Variable amino acid
CVPNQFPCGNGHCLPRDWLCDGVNDCGDSSDESPAHCTEPTCLPSQFQCGSGYCISQRWVCDGENDCEDSSXXANCAGSVPT

SEQ ID NO: 710 - protein, 78 aa, Artificial Sequence
  Description of Artificial Sequence: Synthetic polypeptide
CRAGQFRCSSGHCLPRRLLCDGEDDCVDGSDETGCTQRTCLPSQFQCGSGYCISQRWVCDGENDCEDSSDEKGCTPHT

SEQ ID NO: 711 - protein, 80 aa, Artificial Sequence
  Description of Artificial Sequence: Synthetic polypeptide
CQPNQFRCSNGRCVPLNLLCDGVPDCEDGSDEEGCPPRTCLPSQFQCGSGYCISQRWVCDGENDCEDSSDEANCAGSVPT

SEQ ID NO: 712 - protein, 80 aa, Artificial Sequence
  Description of Artificial Sequence: Synthetic polypeptide
CRSSQFRCSSGQCVSLGWVCDGVNDCPDSSDETGCPKRTCLPSQFQCGSGYCISQRWVCDGENDCEDSSDEANCAGSVPT

SEQ ID NO: 713 - protein, 81 aa, Artificial Sequence
  Description of Artificial Sequence: Synthetic polypeptide
CHAIAQFGCKSGRCLSLGLLCDGVDDCADGSDEAGCPTRTCLPSQFQCGSGYCISQRWVCDGENDCEDSSDEANCAGSVPT

SEQ ID NO: 714 - protein, 82 aa, Artificial Sequence
  Description of Artificial Sequence: Synthetic polypeptide
CPPSQFTCSNGNCLSPTLLCDGVNDCVDDSDETSCAASVHTCLPSQFQCGSGYCISQRWVCDGENDCEDSSDEANCAGSVPT

SEQ ID NO: 715 - protein, 81 aa, Artificial Sequence
  Description of Artificial Sequence: Synthetic polypeptide
CLADQFKCHNTNICIPGRLGCDGDPDCEDDSDEKGCPPHTCLPSQFQCGSGYCISQRWVCDGENDCEDSSDEANCAGSVPT

SEQ ID NO: 716 - protein, 80 aa, Artificial Sequence
  Description of Artificial Sequence: Synthetic polypeptide
CPPGEFPCSSGHCLSQALRCDGVPDCEDDSDETGCPPPTCLPSQFQCGSGYCISQRWVCDGENDCEDSSDEANCAGSVPT

SEQ ID NO: 717 - protein, 82 aa, Artificial Sequence
  Description of Artificial Sequence: Synthetic polypeptide
CGANEFTCGNGRCLSPTWLCDGDDDCGDNSDEASCGGTAPTCLPSQFQCGSGYCISQRWVCDGENDCEDSSDEANCAGSVPT

SEQ ID NO: 718 - protein, 84 aa, Artificial Sequence
  Description of Artificial Sequence: Synthetic polypeptide
CLPNEFPCGSGHCIPQAWVCDGENDCQDSSDEAPAHCAAPVPACLPSQFQCGSGYCISQRWVCDGENDCEDSSDEANCAGSVPT

SEQ ID NO: 719 - protein, 80 aa, Artificial Sequence
  Description of Artificial Sequence: Synthetic polypeptide
CPPSQFKCSNGRCLPVQLLCDGVPDCPDGSDETGCPPPTCLPSQFQCGSGYCISQRWVCDGENDCEDSSDEANCAGSVPT

SEQ ID NO: 720 - protein, 80 aa, Artificial Sequence
  Description of Artificial Sequence: Synthetic polypeptide
CLASQFRCGNGSCLSQTLLCDGVNDCADNSDEVSCPPPTCLPSQFQCGSGYCISQRWVCDGENDCEDSSDEANCAGSVPT

SEQ ID NO: 721 - protein, 82 aa, Artificial Sequence
  Description of Artificial Sequence: Synthetic polypeptide
CLPSQFQCGSGYCISQRWVCDGENDCEDGSDEESCTGPGHTCLPSQFQCGSGYCISQRWVCDGENDCEDSSDEANCAGSVPT

SEQ ID NO: 722 - protein, 81 aa, Artificial Sequence
  Description of Artificial Sequence: Synthetic polypeptide
CPPGEFQCNSGHCLPGTWGCDGEDDCPDGSDESQDCAPPTCLPSQFQCGSGYCISQRWVCDGENDCEDSSDEANCAGSVPT

SEQ ID NO: 723 - protein, 80 aa, Artificial Sequence
  Description of Artificial Sequence: Synthetic polypeptide
CPSSEFKCNNGQCLPVRWLCDGVNDCLDSSDEASCAARTCLPSQFQCGSGYCISQRWVCDGENDCEDSSDEANCAGSVPT

SEQ ID NO: 724 - protein, 81 aa, Artificial Sequence
  Description of Artificial Sequence: Synthetic polypeptide
CHPPSQFRCSNGQCLPLTWRCDGVNDCGDNSDEEDCPERTCLPSQFQCGSGYCISQRWVCDGENDCEDSSDEANCAGSVPT

SEQ ID NO: 725 - protein, 80 aa, Artificial Sequence
  Description of Artificial Sequence: Synthetic polypeptide
CLANEFRCSSGQCIPARWLCDGVNDCVDDSDEKDCPARTCLPSQFQCGSGYCISQRWVCDGENDCEDSSDEANCAGSVPT

SEQ ID NO: 726 - protein, 81 aa, Artificial Sequence
  Description of Artificial Sequence: Synthetic polypeptide
CLPGQFRCHSTDTCLPESWVCDGVNDCADDSDEASCPPHTCLPSQFQCGSGYCISQRWVCDGENDCEDSSDEANCAGSVPT

SEQ ID NO: 727 - protein, 82 aa, Artificial Sequence
  Description of Artificial Sequence: Synthetic polypeptide
CLSSQFRCDSGRCISQDWLCDGVNDCQDGSDESLAICPPHTCLPSQFQCGSGYCISQRWVCDGENDCEDSSDEANCAGSVPT

SEQ ID NO: 728 - protein, 80 aa, Artificial Sequence
  Description of Artificial Sequence: Synthetic polypeptide
CPAGQFTCGSGKCVSGGLLCDGDNDCQDGSDEAGCATRTCLPSQFQCGSGYCISQRWVCDGENDCEDSSDEANCAGSVPT

SEQ ID NO: 729 - protein, 80 aa, Artificial Sequence
  Description of Artificial Sequence: Synthetic polypeptide
CAPDQFKCGNGNCLPLPWVCDGDNDCGDNSDEANCPQHTCLPSQFQCGSGYCISQRWVCDGENDCEDSSDEANCAGSVPT

SEQ ID NO: 730 - protein, 84 aa, Artificial Sequence
  Description of Artificial Sequence: Synthetic polypeptide
CAPSQFRCESGQCLPANWRCDGENDCQDGSDESPAICEGTAPTCLPSQFQCGSGYCISQRWVCDGENDCEDSSDEANCAGSVPT

SEQ ID NO: 731 - protein, 80 aa, Artificial Sequence
  Description of Artificial Sequence: Synthetic polypeptide
CPSNQFTCRSGSCLSLAWLCDGVNDCPDNSDEADCAERTCLPSQFQCGSGYCISQRWVCDGENDCEDSSDEANCAGSVPT

SEQ ID NO: 732 - protein, 83 aa, Artificial Sequence
  Description of Artificial Sequence: Synthetic polypeptide
CPSSEFPCHGNSRCIPLTWLCDGDNDCGDDSDEKNCEAAGPTCLPSQFQCGSGYCISQRWVCDGENDCEDSSDEANCAGSVPT

SEQ ID NO: 733 - protein, 82 aa, Artificial Sequence
  Description of Artificial Sequence: Synthetic polypeptide
CQPSQFRCGNGHCLPPTLVCDGENDCRDNSDETSCATAVRTCLPSQFQCGSGYCISQRWVCDGENDCEDSSDEANCAGSVPT

SEQ ID NO: 734 - protein, 80 aa, Artificial Sequence
  Description of Artificial Sequence: Synthetic polypeptide
CRADEFRCSSGHCIPAPWGCDGVNDCEDGSDEAGCPARTCLPSQFQCGSGYCISQRWVCDGENDCEDSSDEANCAGSVPT

SEQ ID NO: 735 - protein, 83 aa, Artificial Sequence
  Description of Artificial Sequence: Synthetic polypeptide
CAANEFRCRSTNTCIPQQWLCDGVNDCQDDSDEKSCRTPAPTCLPSQFQCGSGYCISQRWVCDGENDCEDSSDEANCAGSVPT

SEQ ID NO: 736 - protein, 83 aa, Artificial Sequence
  Description of Artificial Sequence: Synthetic polypeptide
CAPSQFPCSSNDICVPRRWRCDGVDDCGDSSDEASCGTSVRTCLPSQFQCGSGYCISQRWVCDGENDCEDSSDEANCAGSVPT

SEQ ID NO: 737 - protein, 80 aa, Artificial Sequence
  Description of Artificial Sequence: Synthetic polypeptide
CLPDQFPCSNGRCLPPTWVCDGENDCQDGSDEADCTEPTCLPSQFQCGSGYCISQRWVCDGENDCEDSSDEANCAGSVPT

SEQ ID NO: 738 - protein, 80 aa, Artificial Sequence
  Description of Artificial Sequence: Synthetic polypeptide
CLPNQFRCRNGQCLPQNWLCDGVNDCGDSSDETNCEPHTCLPSQFQCGSGYCISQRWVCDGENDCEDSSDEANCAGSVPT

SEQ ID NO: 739 - protein, 80 aa, Artificial Sequence
  Description of Artificial Sequence: Synthetic polypeptide
CQPSQFQCNNGHCLSVRWLCDGVDDCQDGSDETDCPTRTCLPSQFQCGSGYCISQRWVCDGENDCEDSSDEANCAGSVPT

SEQ ID NO: 740 - protein, 80 aa, Artificial Sequence
  Description of Artificial Sequence: Synthetic polypeptide
  MOD_RES (14)..(14): Variable amino acid
CRSNEFTCSSGSCXPLAWVCDGVNDCLDDSDEAGCPAPTCLPSQFQCGSGYCISQRWVCDGENDCEDSSDEANCAGSVPT

SEQ ID NO: 741 - protein, 82 aa, Artificial Sequence
  Description of Artificial Sequence: Synthetic polypeptide
CLSGEFKCNSGHCIPGPWLCDGDDDCPDGSDETDCGSPGPTCLPSQFQCGSGYCISQRWVCDGENDCEDSSDEANCAGSVPT

SEQ ID NO: 742 - protein, 83 aa, Artificial Sequence
  Description of Artificial Sequence: Synthetic polypeptide
CPADQFRCSNGRCIPRTWVCDGVDDCGDGSDESPLCESAAHTCLPSQFQCGSGYCISQRWVCDGENDCEDSSDEANCAGSVPT

SEQ ID NO: 743 - protein, 83 aa, Artificial Sequence
  Description of Artificial Sequence: Synthetic polypeptide
CVPSQFQCRNNGICIPQNWHCDGVPDCEDSSDEESCGTTVHTCLPSQFQCGSGYCISQRWVCDGENDCEDSSDEANCAGSVPT

SEQ ID NO: 744 - protein, 82 aa, Artificial Sequence
  Description of Artificial Sequence: Synthetic polypeptide
CLPSEFPCDSGQCLPLAWLCDGVDDCRDSSDESLEICPKHTCLPSQFQCGSGYCISQRWVCDGENDCEDSSDEANCAGSVPT

SEQ ID NO: 745 - protein, 84 aa, Artificial Sequence
  Description of Artificial Sequence: Synthetic polypeptide
CPPGEFKCNSGNCVSPTWGCDGVDDCGDDSDEASAICEAPEHTCLPSQFQCGSGYCISQRWVCDGENDCEDSSDEANCAGSVPT

SEQ ID NO: 746 - protein, 82 aa, Artificial Sequence
  Description of Artificial Sequence: Synthetic polypeptide
CPPGQFPCSNGRCVPQRLRCDGDPDCEDNSDEAGCATPEPTCLPSQFQCGSGYCISQRWVCDGENDCEDSSDEANCAGSVPT

SEQ ID NO: 747 - protein, 80 aa, Artificial Sequence
  Description of Artificial Sequence: Synthetic polypeptide
CVANEFRCGNGHCVPLAWLCDGVPDCVDDSDETSCQARTCLPSQFQCGSGYCISQRWVCDGENDCEDSSDEANCAGSVPA

SEQ ID NO: 748 - protein, 80 aa, Artificial Sequence
  Description of Artificial Sequence: Synthetic polypeptide
CQPGEFRCRNGRCLPLAWLCDGVDDCVDGSDETNCAARTCLPSQFQCGSGYCIPQRWVCDGENDCEDSSDEANCAGSVPT

SEQ ID NO: 749 - protein, 80 aa, Artificial Sequence
  Description of Artificial Sequence: Synthetic polypeptide
CGASEFRCDSGHCISPDWRCDGDNDCVDGSDEKSCEQRTCLPSQFQCGSGYCFSQRWVCDGENDCEDGSDEANCAGSVPT

SEQ ID NO: 750 - protein, 82 aa, Artificial Sequence
  Description of Artificial Sequence: Synthetic polypeptide
  MOD_RES (54)..(54): Variable amino acid
  MOD_RES (57)..(59): Variable amino acid
  MOD_RES (62)..(63): Variable amino acid
CRADEFTCNNGRCVPQTWVCDGDPDCEDSSDEKGCTASVHTCLPSQFQCGSGYXISXXXVCXXENDCEDSSDEANCAGSVPT

SEQ ID NO: 751 - protein, 84 aa, Artificial Sequence
  Description of Artificial Sequence: Synthetic polypeptide
CLPSQFQCGSGYCISQRWVCDGENDCEDSSDEANCAGSVPTCLPSEFQCGNGRCLPLRLLCDGDDDCGDNSDEPLATCETSAPT

SEQ ID NO: 752 - protein, 80 aa, Artificial Sequence
  Description of Artificial Sequence: Synthetic polypeptide
CRSNQFQCGSGYCISQRWVCDGENDCEDSSDEANCAGSVPTCLPGQFRCNSGQCLPLQWACDGVDDCADNSDEASCEPPT

SEQ ID NO: 753 - protein, 81 aa, Artificial Sequence
  Description of Artificial Sequence: Synthetic polypeptide
CAAGQFQCHSTSRCVSLRWVCDGEDDCRDGSDEEGCTTAVPTCLPDQFQCGSGYCLPQRWVCDGVDDCEDSSDEKGCTPHT

SEQ ID NO: 754 - protein, 80 aa, Artificial Sequence
  Description of Artificial Sequence: Synthetic polypeptide
CPPSQFPCNSGNCVSAAWVCDGVDDCGDDSDESLAICPTSTCLPDQFQCGSGYCLPQRWVCDGVDDCEDSSDEKGCTPHT

SEQ ID NO: 755 - protein, 79 aa, Artificial Sequence
  Description of Artificial Sequence: Synthetic polypeptide
CRASEFRCRSYERCISPRWVCDGVNDCGDNSDETGCPPRTCLPDQFQCGSGYCLPQRWVCDGVDDCEDSSDEKGCTPHT

SEQ ID NO: 756 - protein, 78 aa, Artificial Sequence
  Description of Artificial Sequence: Synthetic polypeptide
CPLDQFTCGNGSCLPANLLCDGVNDCEDNSDEAGCPTRTCLPDQFQCGSGYCLPQRWVCDGVDDCEDSSDEKGCTPHM

SEQ ID NO: 757 - protein, 83 aa, Artificial Sequence
  Description of Artificial Sequence: Synthetic polypeptide
  MOD_RES (63)..(63): Variable amino acid
  MOD_RES (66)..(66): Variable amino acid
  MOD_RES (68)..(68): Variable amino acid
  MOD_RES (73)..(73): Variable amino acid
CPAGQFPCDSGRCVPQPWRCDGVNDCEDGSDEAPATCPEHTCLPDQFQCGSGYCLPQAWVLRXRKXLXGQLGXSKTVQAPYLT

SEQ ID NO: 758 - protein, 81 aa, Artificial Sequence
  Description of Artificial Sequence: Synthetic polypeptide
CRPSQFQCQNSSRCIPLGWRCDGDNDCEDGSDEKDCTATARTCLPDQFQCGSGYCLPQAWVCDGENDCEDGSDETNCPART

SEQ ID NO: 759 - protein, 80 aa, Artificial Sequence
  Description of Artificial Sequence: Synthetic polypeptide
CLANQFRCGNGRCVSPSWLCDGVDDCGDDSDEASCAAAEPTCLPDQFQCGSGYCLPQAWVCDGDNDCEDGSDETNCPART

SEQ ID NO: 760 - protein, 78 aa, Artificial Sequence
  Description of Artificial Sequence: Synthetic polypeptide
CRPNQFPCGNGHCLPGRWLCDGDDDCPDGSDEEGWPPPTCLPDQFQCGSGYCLPQRWVCDGVDDCEDSSDEKGCTPHT

SEQ ID NO: 761 - protein, 82 aa, Artificial Sequence
  Description of Artificial Sequence: Synthetic polypeptide
  MOD_RES (20)..(20): Variable amino acid
  MOD_RES (63)..(63): Variable amino acid
  MOD_RES (72)..(72): Variable amino acid
CPANEFTCDNGHCLPPSLLXDGENDCGDDSDETSCAAPGPTCLPSQFQCGSGYCISQRWVCDXENDCEDSSXEANCAGSVPT

SEQ ID NO: 762 - protein, 82 aa, Artificial Sequence
  Description of Artificial Sequence: Synthetic polypeptide
  MOD_RES (13)..(13): Variable amino acid
  MOD_RES (63)..(63): Variable amino acid
CRSSQFTCNSGSXLPGHLVCDGVDDCEDNSDEENCAGPGRTCLSSEFQCGSGYCISQRWVCDXENDCEDSSNEANCAGSVPT

SEQ ID NO: 763 - protein, 82 aa, Artificial Sequence
  Description of Artificial Sequence: Synthetic polypeptide
  MOD_RES (20)..(20): Variable amino acid
CQANEFTCSSGNCLSPALLXDGVDDCGDNSDETNCASPAPTCLPSQFQCGSGYCISQRWVCDGENDCEDSSDEANCAGSVPT

SEQ ID NO: 764 - protein, 80 aa, Artificial Sequence
  Description of Artificial Sequence: Synthetic polypeptide
CEAGEFRCRNGSCIPEAWGCDGVNDYLDNSDETNCPAHTCLSSEFQCGSGYCISQRWVCDGENDCEDSSDEANCAGSVPT

SEQ ID NO: 765 - protein, 80 aa, Artificial Sequence
  Description of Artificial Sequence: Synthetic polypeptide
  MOD_RES (20)..(20): Variable amino acid
CPSGQFRCDNGHCLSPPLLXDGVNDCGDDSDETGCTQRTCLPSQFQCGSGYCISQRWVCDGENDCEDSSDEANCAGSVPT

SEQ ID NO: 766 - protein, 81 aa, Artificial Sequence
  Description of Artificial Sequence: Synthetic polypeptide
  MOD_RES (21)..(21): Variable amino acid
CPPSEFRCHSTNTCLSPTLLXDGDNDCGDGSDEASCPQRTCLPSQFQCGSGYCISQRWVCDGENDCEDSSDEANCAGSVPT

SEQ ID NO: 767 - protein, 81 aa, Artificial Sequence
  Description of Artificial Sequence: Synthetic polypeptide
  MOD_RES (21)..(21): Variable amino acid
CVPDEFPCNSGQCVSLAWLCXGVNDCRDGSDEAPYWEPPTCLPSQFQCGSGYCISQRWVCDGENDCEDSSDEANCAGSVPT

SEQ ID NO: 768 - protein, 81 aa, Artificial Sequence
  Description of Artificial Sequence: Synthetic polypeptide
CASNEFPCSNGNCIPGPLRCDGVNDCEDNSDESPLWPLHTCLPSQFQCGSGYCISQRWVCDGENDCEDSSDEANCAGSVPT

SEQ ID NO: 769 - protein, 80 aa, Artificial Sequence
  Description of Artificial Sequence: Synthetic polypeptide
  MOD_RES (20)..(20): Variable amino acid
  MOD_RES (61)..(61): Variable amino acid
  MOD_RES (70)..(70): Variable amino acid
CQSDQFQCNSGSCIPPPWRXDGVDDCRDSSDEEGCPPRTCLPSQFQCGSGYCISQRWFCDXENDCEDSSXEANCAGSVPT

SEQ ID NO: 770 - protein, 80 aa, Artificial Sequence
  Description of Artificial Sequence: Synthetic polypeptide
  MOD_RES (20)..(20): Variable amino acid
CEANQFPCNSGSCIPPRWLXDGVDDCGDNSDEENCTRPTCLPSQFQCGSAYCISQRWVCDGENDGEDSSDEANCAGSVPT

SEQ ID NO: 771 - protein, 80 aa, Artificial Sequence
  Description of Artificial Sequence: Synthetic polypeptide
CLPSQFQCGSGYCISQRWVCDGENDCEDSSDEANCAGSVPTCGGSEFTCGNGRCLPQHWFCDGENDCLDDSDEAGCPAPT

SEQ ID NO: 772 - protein, 81 aa, Artificial Sequence
  Description of Artificial Sequence: Synthetic polypeptide
CASDQFQCNGSRKCISQSWLCDGVNDCPDSSDEKSCPPHTCGANEFQCGSGYCLPRPWVCDGEDDCEDGSDESLAHCQAHT

SEQ ID NO: 773 - protein, 82 aa, Artificial Sequence
  Description of Artificial Sequence: Synthetic polypeptide
CPANQFRCGNGSCLSANWLCDGVNDCLDNSDEKNCGGAGHTCGANEFQCGSGYCLPRPWVCDGEDDCEDGSDESLAHCQAHT

SEQ ID NO: 774 - protein, 80 aa, Artificial Sequence
  Description of Artificial Sequence: Synthetic polypeptide
CPSGQFRCGSGRCIPQHWRCDGDDDCRDGSDEASCAPPTCAPSQFQCGSGYCISQRWVCDGENDCEDSSDEANCAGSVPT

SEQ ID NO: 775 - protein, 81 aa, Artificial Sequence
  Description of Artificial Sequence: Synthetic polypeptide
CQPFDEFECRNGSCIPLPWRCDGVNDCLDDSDEEDCTGSAPTCAPSQFQCGSGYCIPQRWVCDGVDDCEDSSDEKGCTPHT

SEQ ID NO: 776 - protein, 79 aa, Artificial Sequence
  Description of Artificial Sequence: Synthetic polypeptide
CHPPNKFGCSNGRCVSPALLCDGVDDCQDNSDEKGCPPHTCAPNQFQCGSGYCVPAAWVCDGENDCEDSSDEKGCTPHT

SEQ ID NO: 777 - protein, 80 aa, Artificial Sequence
  Description of Artificial Sequence: Synthetic polypeptide
CLPGQFRCNSGRCVPVVLVCDGVDDCADDSDEAGCPPPTCAPNQFQCGSGYCVPAAWVCDGENDCEDSSDEANCAGSVPT

SEQ ID NO: 778 - protein, 80 aa, Artificial Sequence
  Description of Artificial Sequence: Synthetic polypeptide
CAPGQFPCGNGQCLPLHWVCDGVNDCGDNSDEAGCPPHTCAPNQFQCGSGYCVPAAWVCDGENDCEDNSDESSALCQERT

SEQ ID NO: 779 - protein, 81 aa, Artificial Sequence
  Description of Artificial Sequence: Synthetic polypeptide
CPPNQFPCGSGQCLPQPLVCDGDDDCGDGSDELQLCEQPTCAPNQFQCGSGYCVPAAWVCDGENDCEDNSDESSALCQERT

SEQ ID NO: 780 - protein, 82 aa, Artificial Sequence
  Description of Artificial Sequence: Synthetic polypeptide
  MOD_RES (59)..(59): Variable amino acid
CRSNQFQCGSGYCIPVKWLCDGENDCVDGSDEESCPARTCAPDEFRCDSGRCVPRTLGXATGDDDCEGRARMKKTVERPNPT

SEQ ID NO: 781 - protein, 78 aa, Artificial Sequence
  Description of Artificial Sequence: Synthetic polypeptide
CRANQFQCGSGYCIPRPWLCDGENDCEDGSDETNCPARTCAANEFTCGNGHCLPPTWACDGVNDCQDGSDEASCQTPT

SEQ ID NO: 782 - protein, 119 aa, Artificial Sequence
  Description of Artificial Sequence: Synthetic polypeptide
CRASQFQCGSGYCIPRPWLCDGDNDCEDDSDETNCTPRTCLPDQFRCGNGQCIPLDWVCDGVNDCADNSDEAGCPPRTCLPSQFQCGSGYCISQRWVCDGENDCEDSSDEANCAGSVPT

SEQ ID NO: 783 - protein, 122 aa, Artificial Sequence
  Description of Artificial Sequence: Synthetic polypeptide
CLPDQFPCENGKCLPVNLVCDGDDDCPDGSDESEVCAGAVRTCLPDQFRCGNGQCIPLDWVCDGVNDCADNSDETGCPTRTCLPSQFQCGSGWCISQRWVCDGENDCEDSSDEANCAGSVPT

SEQ ID NO: 784 - protein, 126 aa, Artificial Sequence
  Description of Artificial Sequence: Synthetic polypeptide
CLSSQFQCDNGNCVPQQWVCDGDNDCLDDSDETSCSAPASEPPGSLCPASQFPCSSGHCVPLNWVCDGVNDCVDGSDEAGCPPRTCLPDQFQCGSGYCISQRWVCDGENDCEDSSDEANCAGSVPT

SEQ ID NO: 785 - protein, 119 aa, Artificial Sequence
  Description of Artificial Sequence: Synthetic polypeptide
CQASEFPCDSGQCIPQPLGCDGDNDCADNSDEESCQPRTCPASQFPCSSGHCVPLNWVCDGVNDCVDGSDEAGCPPRTCLPDQFQCGSGYCISQRWVCDGENDCEDSSDEANCAGSVPT

SEQ ID NO: 786 - protein, 125 aa, Artificial Sequence
  Description of Artificial Sequence: Synthetic polypeptide
CLPNQFTCDSGNCVPQALGCDGDNDCEDNSDESPALCAAPAHTCQANEFTCSSGNCLSPALLCDGVDDCGDNSDETYCAGPAPTCLPSQFRCGSGCCFSQRWVCDGKNDCEDSSDEANCAGSLPT

SEQ ID NO: 787 - protein, 125 aa, Artificial Sequence
  Description of Artificial Sequence: Synthetic polypeptide
CLPNEFTCDSGNCVPQALGCDGDNDCEDNSDESPALCAAPAHTCQANEFTCSSGNCLSPALLCDGVDDCGDNSDETYCASPAPTCLPSQFQCGSGYCISQRWVCDGENDCEDSSDEANCAGSVPT

SEQ ID NO: 788 - protein, 120 aa, Artificial Sequence; identical to SEQ ID NO: 22
  Description of Artificial Sequence: Synthetic polypeptide

SEQ ID NO: 789 - protein, 143 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(19): Variable amino acid
  MOD_RES (23)..(23): Asp or Glu
  MOD_RES (24)..(24): Asp or Asn
  MOD_RES (27)..(27): Variable amino acid
  MOD_RES (29)..(29): Variable amino acid
  MOD_RES (33)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (43)..(43): Variable amino acid that may or may not be present
  MOD_RES (44)..(44): Variable amino acid
  MOD_RES (45)..(45): Variable amino acid that may or may not be present
  MOD_RES (46)..(46): Variable amino acid
  MOD_RES (47)..(47): Variable amino acid that may or may not be present
  MOD_RES (48)..(48): Variable amino acid
  MOD_RES (49)..(49): Variable amino acid that may or may not be present
  MOD_RES (50)..(50): Variable amino acid
  MOD_RES (51)..(51): Variable amino acid that may or may not be present
  MOD_RES (52)..(52): Variable amino acid
  MOD_RES (53)..(53): Variable amino acid that may or may not be present
  MOD_RES (54)..(54): Variable amino acid
  MOD_RES (55)..(55): Variable amino acid that may or may not be present
  MOD_RES (57)..(59): Variable amino acid
  MOD_RES (60)..(60): Glu or Gln
  MOD_RES (62)..(62): Variable amino acid
  MOD_RES (64)..(65): Variable amino acid
  MOD_RES (66)..(66): Variable amino acid that may or may not be present
  MOD_RES (67)..(69): Variable amino acid
  MOD_RES (71)..(71): Ile, Leu or Val
  MOD_RES (72)..(75): Variable amino acid
  MOD_RES (76)..(76): Ile, Leu or Val
  MOD_RES (81)..(81): Asp or Asn
  MOD_RES (84)..(84): Variable amino acid
  MOD_RES (86)..(86): Variable amino acid
  MOD_RES (90)..(91): Variable amino acid
  MOD_RES (93)..(93): Variable amino acid
  MOD_RES (94)..(94): Variable amino acid that may or may not be present
  MOD_RES (95)..(95): Variable amino acid
  MOD_RES (96)..(96): Variable amino acid that may or may not be present
  MOD_RES (98)..(99): Variable amino acid
  MOD_RES (104)..(104): Variable amino acid
  MOD_RES (107)..(107): Lys, Gln or Arg
  MOD_RES (112)..(112): Variable amino acid
  MOD_RES (114)..(114): Phe, Ile, Leu, Met or Val
  MOD_RES (115)..(115): Variable amino acid
  MOD_RES (117)..(117): Variable amino acid
  MOD_RES (123)..(123): Glu, Lys or Gln
  MOD_RES (129)..(129): Variable amino acid
  MOD_RES (133)..(133): Ala, Ser or Thr
  MOD_RES (136)..(137): Variable amino acid
  MOD_RES (138)..(138): Variable amino acid that may or may not be present
  MOD_RES (139)..(139): Variable amino acid
  MOD_RES (140)..(140): Variable amino acid that may or may not be present
  MOD_RES (141)..(142): Variable amino acid
CXXXXFXCXXGXCXXXXXXCDGXXDCXDXSDEXXXXXXXXXXXXXXXXXXXXXXXCXXXXFXCXXXXXXCXXXXXXCDGVXDCXDXSDEXXCXXXXPXXTCLPXQFXCGSGXCXXQXWVCDGXNDCEDXSDEXNCXXXXXXXT

SEQ ID NO: 790 - protein, 143 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (16)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (43)..(43): Variable amino acid that may or may not be present
  MOD_RES (44)..(44): Variable amino acid
  MOD_RES (45)..(45): Variable amino acid that may or may not be present
  MOD_RES (46)..(46): Variable amino acid
  MOD_RES (47)..(47): Variable amino acid that may or may not be present
  MOD_RES (48)..(48): Variable amino acid
  MOD_RES (49)..(49): Variable amino acid that may or may not be present
  MOD_RES (50)..(50): Variable amino acid
  MOD_RES (51)..(51): Variable amino acid that may or may not be present
  MOD_RES (52)..(52): Variable amino acid
  MOD_RES (53)..(53): Variable amino acid that may or may not be present
  MOD_RES (54)..(54): Variable amino acid
  MOD_RES (55)..(55): Variable amino acid that may or may not be present
  MOD_RES (57)..(59): Variable amino acid
  MOD_RES (60)..(60): Glu or Gln
  MOD_RES (62)..(62): Variable amino acid
  MOD_RES (64)..(65): Variable amino acid
  MOD_RES (66)..(66): Variable amino acid that may or may not be present
  MOD_RES (67)..(67): Variable amino acid
  MOD_RES (69)..(69): Variable amino acid
  MOD_RES (71)..(71): Ile, Leu or Val
  MOD_RES (72)..(75): Variable amino acid
  MOD_RES (76)..(76): Ile, Leu or Val
  MOD_RES (81)..(81): Asp or Asn
  MOD_RES (84)..(84): Variable amino acid
  MOD_RES (86)..(86): Variable amino acid
  MOD_RES (90)..(90): Ala, Ser or Thr
  MOD_RES (91)..(91): Variable amino acid
  MOD_RES (93)..(93): Variable amino acid
  MOD_RES (94)..(94): Variable amino acid that may or may not be present
  MOD_RES (95)..(95): Variable amino acid
  MOD_RES (96)..(96): Variable amino acid that may or may not be present
  MOD_RES (98)..(99): Variable amino acid
  MOD_RES (104)..(104): Variable amino acid
  MOD_RES (107)..(107): Lys, Gln or Arg
  MOD_RES (112)..(112): Variable amino acid
  MOD_RES (114)..(114): Phe, Ile, Leu, Met or Val
  MOD_RES (123)..(123): Glu, Lys or Gln
  MOD_RES (137)..(137): Variable amino acid
  MOD_RES (138)..(138): Variable amino acid that may or may not be present
  MOD_RES (139)..(139): Variable amino acid
  MOD_RES (140)..(140): Variable amino acid that may or may not be present
  MOD_RES (141)..(141): Ile, Leu or Val
CXXXXFXCXXGXCXPXXXXCDGDXDCXDXSDEXXXXXXXXXXXXXXXXXXXXXXXCXXXXFXCXXXXGXCXXXXXXCDGVXDCXDXSDEXXCXXXXPXXTCLPXQFXCGSGXCXSQRWVCDGXNDCEDSSDEANCAXXXXXPT

SEQ ID NO: 791 - protein, 143 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (16)..(19): Variable amino acid
  MOD_RES (24)..(24): Asp or Asn
  MOD_RES (27)..(27): Variable amino acid
  MOD_RES (29)..(29): Variable amino acid
  MOD_RES (33)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (43)..(43): Variable amino acid that may or may not be present
  MOD_RES (44)..(44): Variable amino acid
  MOD_RES (45)..(45): Variable amino acid that may or may not be present
  MOD_RES (46)..(46): Variable amino acid
  MOD_RES (47)..(47): Variable amino acid that may or may not be present
  MOD_RES (48)..(48): Variable amino acid
  MOD_RES (49)..(49): Variable amino acid that may or may not be present
  MOD_RES (50)..(50): Variable amino acid
  MOD_RES (51)..(51): Variable amino acid that may or may not be present
  MOD_RES (52)..(52): Variable amino acid
  MOD_RES (53)..(53): Variable amino acid that may or may not be present
  MOD_RES (54)..(54): Variable amino acid
  MOD_RES (55)..(55): Variable amino acid that may or may not be present
  MOD_RES (57)..(59): Variable amino acid
  MOD_RES (60)..(60): Glu or Gln
  MOD_RES (62)..(62): Variable amino acid
  MOD_RES (64)..(65): Variable amino acid
  MOD_RES (66)..(66): Variable amino acid that may or may not be present
  MOD_RES (67)..(67): Variable amino acid
  MOD_RES (69)..(69): Variable amino acid
  MOD_RES (71)..(71): Ile, Leu or Val
  MOD_RES (72)..(75): Variable amino acid
  MOD_RES (76)..(76): Ile, Leu or Val
  MOD_RES (81)..(81): Asp or Asn
  MOD_RES (84)..(84): Variable amino acid
  MOD_RES (86)..(86): Variable amino acid
  MOD_RES (90)..(90): Ala, Ser or Thr
  MOD_RES (91)..(91): Variable amino acid
  MOD_RES (93)..(93): Variable amino acid
  MOD_RES (94)..(94): Variable amino acid that may or may not be present
  MOD_RES (95)..(95): Variable amino acid
  MOD_RES (96)..(96): Variable amino acid that may or may not be present
  MOD_RES (98)..(99): Variable amino acid
  MOD_RES (104)..(104): Variable amino acid
  MOD_RES (112)..(112): Phe, Trp or Tyr
  MOD_RES (137)..(137): Variable amino acid
  MOD_RES (138)..(138): Variable amino acid that may or may not be present
  MOD_RES (139)..(139): Variable amino acid
  MOD_RES (140)..(140): Variable amino acid that may or may not be present
CXXXXFXCXXGXCXPXXXXCDGDXDCXDXSDEXXXXXXXXXXXXXXXXXXXXXXXCXXXXFXCXXXXGXCXXXXXXCDGVXDCXDXSDEXXCXXXXPXXTCLPXQFQCGSGXCISQRWVCDGENDCEDSSDEANCAXXXXVPT

SEQ ID NO: 792 - protein, 119 aa, Artificial Sequence
  Description of Artificial Sequence: Synthetic polypeptide
CLPDQFRCGNGQCIPLDWVCDGVNDCEDSSDEAGCPPRTCLPDQFQCGSGYCLPQRWVCDGVDDCEDSSDEKGCTPHTCLSDQFQCGSGHCLPASWRCDGEDDCADSSDETSCTASEPT

SEQ ID NO: 793 - protein, 128 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGVDDCEDSSDEKGCTPHTCEPGQFPCESGQCLPPPWVCDGVNDCADNSDEEDCGDSHILPFSTPGPST

SEQ ID NO: 794 - protein, 76 aa, Artificial Sequence
  Description of Artificial Sequence: Synthetic polypeptide
CLPSQFQCRNGRCIPLPWLCDGDNDCEDDSDETNCTPRTCPSSQFQCSSGWCIPEDWRCDGVPDCGDGSDEASDHC

SEQ ID NO: 795 - protein, 119 aa, Artificial Sequence
  Description of Artificial Sequence: Synthetic polypeptide
CPSSQFRCSSGRCVPADWLCDGVNDCADNSDETGCPTRTCLPSQFQCGSGYCISQRWVCDGENDCEDSSDEANCAGSVPTCPSDEFRCRNGRCIPRAWRCDGVNDCADNSDEEDCTEHT

SEQ ID NO: 796 - protein, 119 aa, Artificial Sequence
  Description of Artificial Sequence: Synthetic polypeptide
CPSSQFRCSSGRCVPADWLCDGVNDCADNSDETGCATRTCLPSQFQCGSGYCISQRWVCDGENDCEDSSDEANCAGSVPTCPSDEFRCRNGRCIPRAWRCDGVNDCADNSDEEDCTEHT

SEQ ID NO: 797 - protein, 119 aa, Artificial Sequence
  Description of Artificial Sequence: Synthetic polypeptide
CPSSQFRCSSGRCVPADWLCDGVNDCGDNSDEAGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 798 - protein, 119 aa, Artificial Sequence
  Description of Artificial Sequence: Synthetic polypeptide
CPSDEFTCDSGRCVSLNWLCDGVNDCGDNSDEAGCPTRTCLPSQFQCGSGYCISQRWVCDGENDCEDSSDEANCAGSVPTCPSDEFRCRNGRCIPRAWRCDGVNDCADNSDEEDCTEHT

SEQ ID NO: 799 - protein, 119 aa, Artificial Sequence
  Description of Artificial Sequence: Synthetic polypeptide
CPSDEFTCDSGRCVSLNWLCDGVNDCGDNSDEAGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 800 - protein, 119 aa, Artificial Sequence; identical to SEQ ID NO: 17
  Description of Artificial Sequence: Synthetic polypeptide

SEQ ID NO: 801 - protein, 119 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDGSDEANCAGSVPTCPSDEFRCRNGRCVPRAWRCDGVNDCADNSDEEDCTEHT

SEQ ID NO: 802 - protein, 119 aa, Artificial Sequence; identical to SEQ ID NO: 19
  Description of Artificial Sequence: Synthetic polypeptide

SEQ ID NO: 803 - protein, 119 aa, Artificial Sequence; identical to SEQ ID NO: 20
  Description of Artificial Sequence: Synthetic polypeptide

SEQ ID NO: 804 - protein, 119 aa, Artificial Sequence
  Description of Artificial Sequence: Synthetic polypeptide
CLPDQFRCGNGQCIPLDWVCDGVNDCEDDSDEESCPPRTCLPDQFQCGSGYCISQRWVCDGENDCEDGSDEANCAGSVPTCPSDEFRCRNGRCIPRAWRCDGVNDCADNSDEEDCTEHT

SEQ ID NO: 805 - protein, 119 aa, Artificial Sequence; identical to SEQ ID NO: 14
  Description of Artificial Sequence: Synthetic polypeptide

SEQ ID NO: 806 - protein, 119 aa, Artificial Sequence; identical to SEQ ID NO: 15
  Description of Artificial Sequence: Synthetic polypeptide

SEQ ID NO: 807 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDSSDEANCAGSVPTCPSDEFRCRNGRCIPRAWRCDGVNDCADNSDEEDCTENT

SEQ ID NO: 808 - protein, 119 aa, Artificial Sequence; identical to SEQ ID NO: 21
  Description of Artificial Sequence: Synthetic polypeptide

SEQ ID NO: 809 - protein, 119 aa, Artificial Sequence
  Description of Artificial Sequence: Synthetic polypeptide
CEANELRCSSGRCLSVHWLCDGVDDCEDSSDEAGCPPRTCLPDQFQCGSGYCLPQRWVCDGENDCEDGSDEANCAGSVPTCPSDEFRCRNGRCIPRAWRCDGVNDCADNSDEEDCTEHT

SEQ ID NO: 810 - protein, 121 aa, Artificial Sequence
  Description of Artificial Sequence: Synthetic polypeptide
CGSNEFTCSNGRCIPPTLLCDGVNDCGDDSDETGCATPVRTCLPSQFQCGSGYCISQRWVCDGENDCEDGSDEANCAGSVPTCPSDEFRCRNGRCIPRAWRCDGVNDCADNSDEEDCTEHT

SEQ ID NO: 811 - protein, 119 aa, Artificial Sequence; identical to SEQ ID NO: 16
  Description of Artificial Sequence: Synthetic polypeptide

SEQ ID NO: 812 - protein, 121 aa, Artificial Sequence
  Description of Artificial Sequence: Synthetic polypeptide
CPSSQFRCSSGRCVPADWLCDGVNDCADNSDETGCPTRTCLPSQFQCGSGYCISQRWVCDGENDCEDGSDEANCAGSVPTCPSDEFRCRNGRCIPPGWLCDGVDDCVDDSDEEGCRTPART

SEQ ID NO: 813 - protein, 119 aa, Artificial Sequence
  Description of Artificial Sequence: Synthetic polypeptide
CPSSQFRCSSGRCVPADWLCDGVNDCADNSDETGCPTRTCLPSQFQCGSGYCISQRWVCDGENDCEDSSDEANCAGSVPTCPPGQFTCNNGRCVPPTWLCDGEDDCQDDSDEKNCKAPT

SEQ ID NO: 814 - protein, 127 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(18): Variable amino acid
  MOD_RES (19)..(19): Ile, Leu or Val
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (45)..(45): Variable amino acid
  MOD_RES (47)..(47): Variable amino acid
  MOD_RES (57)..(57): Ile, Leu or Val
  MOD_RES (58)..(58): Variable amino acid
  MOD_RES (72)..(72): Variable amino acid
  MOD_RES (87)..(88): Variable amino acid
  MOD_RES (89)..(89): Glu or Gln
  MOD_RES (91)..(91): Variable amino acid
  MOD_RES (93)..(93): Variable amino acid
  MOD_RES (98)..(98): Ile or Val
  MOD_RES (100)..(101): Variable amino acid
  MOD_RES (103)..(103): Variable amino acid
  MOD_RES (107)..(107): Variable amino acid
  MOD_RES (108)..(108): Asp or Asn
  MOD_RES (111)..(111): Variable amino acid
  MOD_RES (113)..(113): Asp or Asn
  MOD_RES (117)..(118): Variable amino acid
  MOD_RES (120)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
CXXXXXXCXXGXCXXXXXXCDGVXDCXDXSDEXXCXXXXXXXTCXPXQFQCGSGYCXXQRWVCDGENDCEDXSDEANCAGSVPTCPXXXFXCXNGRCXPXXWXCDGXXDCXDXSDEXXCXXXXXXXT

SEQ ID NO: 815 - protein, 127 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(18): Variable amino acid
  MOD_RES (19)..(19): Ile, Leu or Val
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (45)..(45): Variable amino acid
  MOD_RES (47)..(47): Variable amino acid
  MOD_RES (57)..(57): Ile, Leu or Val
  MOD_RES (58)..(58): Variable amino acid
  MOD_RES (72)..(72): Variable amino acid
  MOD_RES (98)..(98): Ile or Val
  MOD_RES (100)..(101): Variable amino acid
  MOD_RES (103)..(103): Variable amino acid
  MOD_RES (108)..(108): Asp or Asn
  MOD_RES (111)..(111): Variable amino acid
  MOD_RES (113)..(113): Asp or Asn
  MOD_RES (117)..(118): Variable amino acid
  MOD_RES (120)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
CXXXXXXCXXGXCXXXXXXCDGVXDCXDXSDEXXCXXXXXXXTCXPXQFQCGSGYCXXQRWVCDGENDCEDXSDEANCAGSVPTCPSDEFRCRNGRCXPXXWXCDGVXDCXDXSDEXXCXXXXXXXT

SEQ ID NO: 816 - protein, 127 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(18): Variable amino acid
  MOD_RES (19)..(19): Ile, Leu or Val
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (45)..(45): Variable amino acid
  MOD_RES (47)..(47): Variable amino acid
  MOD_RES (57)..(57): Ile, Leu or Val
  MOD_RES (58)..(58): Variable amino acid
  MOD_RES (72)..(72): Variable amino acid
  MOD_RES (98)..(98): Ile or Val
  MOD_RES (117)..(117): Variable amino acid
  MOD_RES (120)..(120): Ala, Ser or Thr
  MOD_RES (121)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
CXXXXXXCXXGXCXXXXXXCDGVXDCXDXSDEXXCXXXXXXXTCXPXQFQCGSGYCXXQRWVCDGENDCEDXSDEANCAGSVPTCPSDEFRCRNGRCXPRAWRCDGVNDCADNSDEXDCXXXXXXXT

SEQ ID NO: 817 - protein, 127 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(18): Variable amino acid
  MOD_RES (19)..(19): Ile, Leu or Val
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (45)..(45): Variable amino acid
  MOD_RES (47)..(47): Variable amino acid
  MOD_RES (57)..(57): Ile, Leu or Val
  MOD_RES (58)..(58): Variable amino acid
  MOD_RES (72)..(72): Variable amino acid
  MOD_RES (98)..(98): Ile or Val
  MOD_RES (121)..(121): Glu or Gln
  MOD_RES (122)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
CXXXXXXCXXGXCXXXXXXCDGVXDCXDXSDEXXCXXXXXXXTCXPXQFQCGSGYCXXQRWVCDGENDCEDXSDEANCAGSVPTCPSDEFRCRNGRCXPRAWRCDGVNDCADNSDEEDCTXXXXXXT

SEQ ID NO: 818 - protein, 127 aa, Artificial Sequence
  Description of Artificial Sequence: Synthetic polypeptide
  MOD_RES (2)..(4): Variable amino acid
  MOD_RES (5)..(5): Glu or Gln
  MOD_RES (6)..(6): Phe, Leu or Tyr
  MOD_RES (7)..(7): Variable amino acid
  MOD_RES (9)..(10): Variable amino acid
  MOD_RES (12)..(12): Variable amino acid
  MOD_RES (14)..(14): Ile, Leu or Val
  MOD_RES (15)..(17): Variable amino acid
  MOD_RES (19)..(19): Ile, Leu or Val
  MOD_RES (24)..(24): Asp or Asn
  MOD_RES (27)..(27): Variable amino acid
  MOD_RES (29)..(29): Variable amino acid
  MOD_RES (33)..(34): Variable amino acid
  MOD_RES (36)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (45)..(45): Variable amino acid
  MOD_RES (47)..(47): Variable amino acid
  MOD_RES (57)..(57): Ile, Leu or Val
  MOD_RES (58)..(58): Variable amino acid
  MOD_RES (72)..(72): Variable amino acid
  MOD_RES (98)..(98): Ile or Val
  MOD_RES (121)..(121): Glu or Gln
  MOD_RES (122)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
CXXXXXXCXXGXCXXXXWXCDGVXDCXDXSDEXXCXXXXXXXTCXPXQFQCGSGYCXXQRWVCDGENDCEDXSDEANCAGSVPTCPSDEFRCRNGRCXPRAWRCDGVNDCADNSDEEDCTXXXXXXT

SEQ ID NO: 819 - protein, 127 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(10): Variable amino acid
  MOD_RES (12)..(12): Variable amino acid
  MOD_RES (14)..(14): Ile or Val
  MOD_RES (15)..(16): Variable amino acid
  MOD_RES (17)..(17): Asp or Asn
  MOD_RES (19)..(19): Ile, Leu or Val
  MOD_RES (27)..(27): Variable amino acid
  MOD_RES (29)..(29): Variable amino acid
  MOD_RES (33)..(34): Variable amino acid
  MOD_RES (36)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (45)..(45): Variable amino acid
  MOD_RES (47)..(47): Variable amino acid
  MOD_RES (57)..(57): Ile, Leu or Val
  MOD_RES (58)..(58): Variable amino acid
  MOD_RES (72)..(72): Variable amino acid
  MOD_RES (98)..(98): Ile or Val
  MOD_RES (121)..(121): Glu or Gln
  MOD_RES (122)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
CXXXXFXCXXGXCXXXXWXCDGVNDCXDXSDEXXCXXXXXXXTCXPXQFQCGSGYCXXQRWVCDGENDCEDXSDEANCAGSVPTCPSDEFRCRNGRCXPRAWRCDGVNDCADNSDEEDCTXXXXXXT

SEQ ID NO: 820 - protein, 80 aa, Artificial Sequence
  Description of Artificial Sequence: Synthetic polypeptide
CPSDEFTCDSGRCVSLNWLCDGVNDCGDNSDEAGCPTRTCLPSQFQCGSGYCISQRWVCDGENDCEDSSDEANCAGSVPT

SEQ ID NO: 821 - protein, 126 aa, Artificial Sequence
  Description of Artificial Sequence: Synthetic polypeptide
CPSSQFRCSSGRCVPADWLCDGVNDCADNSDETGCPTRTCLPSQFQCGSGYCISQRWVCDGENDCEDGSDEANCAGSVPTCPSDEFRCRNGRCIPRAWRCDGVNDCGDSSDETSCSAPASEPPGSL

SEQ ID NO: 822 - protein, 119 aa, Artificial Sequence
  Description of Artificial Sequence: Synthetic polypeptide
CPSDEFTCDSGRCVSLNWLCDGVNDCGDNSDEAGCPTRTCLPSQFQCGSGYCISQRWVCDGENDCEDSSDEANCAGSVPTCGANEFTCDNGRCLSPDLVCDGVDDCADSSDETDCQKPM

SEQ ID NO: 823 - protein, 121 aa, Artificial Sequence
  Description of Artificial Sequence: Synthetic polypeptide
CPSDEFTCDSGRCVSLNWLCDGVNDCGDNSDEAGCPTRTCLPSQFQCGSGYCISQRWVCDGENDCEDSSDEANCAGSVPTCPPDEFQCNSGSCLSQPLLCDGEDDCGDGSDEESCIAAEHT

SEQ ID NO: 824 - protein, 119 aa, Artificial Sequence
  Description of Artificial Sequence: Synthetic polypeptide
CLSDEFTCDSGRCVSLNWLCDGVNDCGDNSDEAGCPTHTCLPSQFQCGSGYCISQRWVCDGENDCEDSSDEANCAGSVPTCPASEFRCNNGRCIPAQWRCDGVNDCGDDSDEASCQAPT

SEQ ID NO: 825 - protein, 121 aa, Artificial Sequence
  Description of Artificial Sequence: Synthetic polypeptide
CQANEFTCSSGNCLSPALLCDGVDDCGDNSDETNCASPAPTCLPSQFQCGSGYCISQRWVCDGENDCEDSSDEANCAGSVPTCPSDEFRCRNGRCIPRAWRCDGVNDCADNSDEEDCTEHT

SEQ ID NO: 826 - protein, 123 aa, Artificial Sequence
  Description of Artificial Sequence: Synthetic polypeptide
CELNEFTCSSGNCLSPALLCDGVDDCGDNSDETNCASPAPTCLPSQFQCGSGYCISQRWVCDGENDCEDGSDEANCAGSVPTCPSDEFRCRNGRCIPRAWRCDGVNDCADNSDEANCAGSVPT

SEQ ID NO: 827 - protein, 121 aa, Artificial Sequence; identical to SEQ ID NO: 18
  Description of Artificial Sequence: Synthetic polypeptide

SEQ ID NO: 828 - protein, 121 aa, Artificial Sequence
  Description of Artificial Sequence: Synthetic polypeptide
CQANEFTCSSGNCLSPALLCDGVDDCGDNSDETYCASPAPTCLPSQFQCGSGYCISQRWVCDGENDCEDSSDEANCAGSVPTCLSGEFTCENGNCLSLSLVCDGEDDCEDGSDEASCPPPT

SEQ ID NO: 829 - protein, 128 aa, Artificial Sequence
  Description of Artificial Sequence: Synthetic polypeptide
CQANEFTCSSGNCLSPALLCDGVDDCGDNSDETNCASPAPTCLPSQFQCGSGYCISQRWVCDGEHDCEDSSDEANCAGSVPTCAPGEFTCGSGRCVPQTWRCDGVDDCLDSSDETDCSAPASEPPGSL

SEQ ID NO: 830 - protein, 143 aa, Artificial Sequence
  Description of Artificial Sequence: Synthetic polypeptide
  MOD_RES (2)..(4): Variable amino acid
  MOD_RES (5)..(5): Glu or Gln
  MOD_RES (7)..(7): Variable amino acid
  MOD_RES (9)..(9): Variable amino acid
  MOD_RES (12)..(12): Variable amino acid
  MOD_RES (13)..(13): Variable amino acid that may or may not be present
  MOD_RES (14)..(14): Variable amino acid
  MOD_RES (16)..(16): Ile, Leu or Val
  MOD_RES (17)..(20): Variable amino acid
  MOD_RES (26)..(26): Asp or Asn
  MOD_RES (29)..(29): Variable amino acid
  MOD_RES (35)..(35): Ala, Ser or Thr
  MOD_RES (36)..(36): Variable amino acid
  MOD_RES (38)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (43)..(43): Variable amino acid that may or may not be present
  MOD_RES (44)..(44): Variable amino acid
  MOD_RES (45)..(45): Variable amino acid that may or may not be present
  MOD_RES (46)..(46): Variable amino acid
  MOD_RES (71)..(71): Variable amino acid
  MOD_RES (76)..(76): Variable amino acid
  MOD_RES (90)..(92): Variable amino acid
  MOD_RES (95)..(95): Variable amino acid
  MOD_RES (97)..(98): Variable amino acid
  MOD_RES (100)..(100): Variable amino acid
  MOD_RES (102)..(102): Ile, Leu or Val
  MOD_RES (103)..(107): Variable amino acid
  MOD_RES (111)..(111): Variable amino acid
  MOD_RES (112)..(112): Asp or Asn
  MOD_RES (115)..(115): Variable amino acid
  MOD_RES (117)..(117): Variable amino acid
  MOD_RES (121)..(122): Variable amino acid
  MOD_RES (124)..(125): Variable amino acid
  MOD_RES (126)..(126): Variable amino acid that may or may not be present
  MOD_RES (127)..(127): Variable amino acid
  MOD_RES (128)..(128): Variable amino acid that may or may not be present
  MOD_RES (129)..(132): Variable amino acid
  MOD_RES (133)..(133): Variable amino acid that may or may not be present
  MOD_RES (134)..(134): Variable amino acid
  MOD_RES (135)..(135): Variable amino acid that may or may not be present
  MOD_RES (136)..(136): Variable amino acid
  MOD_RES (137)..(137): Variable amino acid that may or may not be present
  MOD_RES (138)..(138): Variable amino acid
  MOD_RES (139)..(139): Variable amino acid that may or may not be present
  MOD_RES (140)..(140): Variable amino acid
  MOD_RES (141)..(141): Variable amino acid that may or may not be present
  MOD_RES (142)..(142): Variable amino acid
  MOD_RES (143)..(143): Variable amino acid that may or may not be present
CXXXXFXCXSGXXXCXXXXXLCDGVXDCXDNSDEXXCXXXXXXXXXTCLPSQFQCGSGYCISQRWVCDGEXDCEDXSDEANCAGSVPTCXXXEFXCXXGXCXXXXXXCDGXXDCXDXSDEXXCXXXXXXXXXXXXXXXXXXXX

SEQ ID NO: 831 - protein, 143 aa, Artificial Sequence
  Description of Artificial Sequence: Synthetic polypeptide
  MOD_RES (2)..(3): Variable amino acid
  MOD_RES (4)..(4): Asp or Asn
  MOD_RES (9)..(9): Variable amino acid
  MOD_RES (12)..(12): Variable amino acid
  MOD_RES (13)..(13): Variable amino acid that may or may not be present
  MOD_RES (14)..(14): Variable amino acid
  MOD_RES (16)..(16): Ile, Leu or Val
  MOD_RES (18)..(20): Variable amino acid
  MOD_RES (26)..(26): Asp or Asn
  MOD_RES (35)..(35): Ala, Ser or Thr
  MOD_RES (36)..(36): Variable amino acid
  MOD_RES (38)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (43)..(43): Variable amino acid that may or may not be present
  MOD_RES (44)..(44): Variable amino acid
  MOD_RES (45)..(45): Variable amino acid that may or may not be present
  MOD_RES (46)..(46): Variable amino acid
  MOD_RES (71)..(71): Variable amino acid
  MOD_RES (76)..(76): Variable amino acid
  MOD_RES (90)..(92): Variable amino acid
  MOD_RES (95)..(95): Variable amino acid
  MOD_RES (97)..(98): Variable amino acid
  MOD_RES (100)..(100): Variable amino acid
  MOD_RES (102)..(102): Ile, Leu or Val
  MOD_RES (103)..(107): Variable amino acid
  MOD_RES (111)..(111): Variable amino acid
  MOD_RES (112)..(112): Asp or Asn
  MOD_RES (115)..(115): Variable amino acid
  MOD_RES (117)..(117): Variable amino acid
  MOD_RES (121)..(122): Variable amino acid
  MOD_RES (124)..(125): Variable amino acid
  MOD_RES (126)..(126): Variable amino acid that may or may not be present
  MOD_RES (127)..(127): Variable amino acid
  MOD_RES (128)..(128): Variable amino acid that may or may not be present
  MOD_RES (129)..(132): Variable amino acid
  MOD_RES (133)..(133): Variable amino acid that may or may not be present
  MOD_RES (134)..(134): Variable amino acid
  MOD_RES (135)..(135): Variable amino acid that may or may not be present
  MOD_RES (136)..(136): Variable amino acid
  MOD_RES (137)..(137): Variable amino acid that may or may not be present
  MOD_RES (138)..(138): Variable amino acid
  MOD_RES (139)..(139): Variable amino acid that may or may not be present
  MOD_RES (140)..(140): Variable amino acid
  MOD_RES (141)..(141): Variable amino acid that may or may not be present
  MOD_RES (142)..(142): Variable amino acid
  MOD_RES (143)..(143): Variable amino acid that may or may not be present
CXXXEFTCXSGXXXCXSXXXLCDGVXDCGDNSDEXXCXXXXXXXXXTCLPSQFQCGSGYCISQRWVCDGEXDCEDXSDEANCAGSVPTCXXXEFXCXXGXCXXXXXXCDGXXDCXDXSDEXXCXXXXXXXXXXXXXXXXXXXX

SEQ ID NO: 832 - protein, 143 aa, Artificial Sequence
  Description of Artificial Sequence: Synthetic polypeptide
  MOD_RES (2)..(2): Variable amino acid
  MOD_RES (3)..(3): Ala or Ser
  MOD_RES (4)..(4): Asp or Asn
  MOD_RES (9)..(9): Variable amino acid
  MOD_RES (12)..(12): Variable amino acid
  MOD_RES (13)..(13): Variable amino acid that may or may not be present
  MOD_RES (14)..(14): Variable amino acid
  MOD_RES (16)..(16): Ile, Leu or Val
  MOD_RES (18)..(20): Variable amino acid
  MOD_RES (26)..(26): Asp or Asn
  MOD_RES (35)..(35): Ala, Ser or Thr
  MOD_RES (36)..(36): Variable amino acid
  MOD_RES (38)..(38): Variable amino acid
  MOD_RES (39)..(39): Variable amino acid that may or may not be present
  MOD_RES (40)..(40): Variable amino acid
  MOD_RES (41)..(41): Variable amino acid that may or may not be present
  MOD_RES (42)..(42): Variable amino acid
  MOD_RES (43)..(43): Variable amino acid that may or may not be present
  MOD_RES (44)..(44): Variable amino acid
  MOD_RES (45)..(45): Variable amino acid that may or may not be present
  MOD_RES (46)..(46): Variable amino acid
  MOD_RES (71)..(71): Variable amino acid
  MOD_RES (90)..(92): Variable amino acid
  MOD_RES (95)..(95): Variable amino acid
  MOD_RES (97)..(98): Variable amino acid
  MOD_RES (100)..(100): Variable amino acid
  MOD_RES (102)..(102): Ile, Leu or Val
  MOD_RES (103)..(107): Variable amino acid
  MOD_RES (111)..(111): Variable amino acid
  MOD_RES (112)..(112): Asp or Asn
  MOD_RES (115)..(115): Variable amino acid
  MOD_RES (117)..(117): Variable amino acid
  MOD_RES (121)..(122): Variable amino acid
  MOD_RES (124)..(125): Variable amino acid
  MOD_RES (126)..(126): Variable amino acid that may or may not be present
  MOD_RES (127)..(127): Variable amino acid
  MOD_RES (128)..(128): Variable amino acid that may or may not be present
  MOD_RES (129)..(132): Variable amino acid
  MOD_RES (133)..(133): Variable amino acid that may or may not be present
  MOD_RES (134)..(134): Variable amino acid
  MOD_RES (135)..(135): Variable amino acid that may or may not be present
  MOD_RES (136)..(136): Variable amino acid
  MOD_RES (137)..(137): Variable amino acid that may or may not be present
  MOD_RES (138)..(138): Variable amino acid
  MOD_RES (139)..(139): Variable amino acid that may or may not be present
  MOD_RES (140)..(140): Variable amino acid
  MOD_RES (141)..(141): Variable amino acid that may or may not be present
  MOD_RES (142)..(142): Variable amino acid
  MOD_RES (143)..(143): Variable amino acid that may or may not be present
CXXXEFTCXSGXXXCXSXXXLCDGVXDCGDNSDEXXCXXXXXXXXXTCLPSQFQCGSGYCISQRWVCDGEXDCEDSSDEANCAGSVPTCXXXEFXCXXGXCXXXXXXCDGXXDCXDXSDEXXCXXXXXXXXXXXXXXXXXXXX

SEQ ID NO: 833 - protein, 120 aa, Artificial Sequence
  Description of Artificial Sequence: Synthetic polypeptide
CLANQFKCDNGRFIPQTWVCDGDNDCLDGSDEPVHCAKRTCPSSQFQCSSGWCISQRWVCDGENDCEDSSDEANCAGSVPTCPSDEFRCRNGRCIPRAWRCDGVNDCADNSDEEDCTEHT

SEQ ID NO: 834 - protein, 120 aa, Artificial Sequence
  Description of Artificial Sequence: Synthetic polypeptide
CLANQFKCDNGRCIPQTWVCDGDNDCLDGSDEPVHCAKRTCPSSQFQCSSGWCISQRWVCDGENDCEDSSDEANCAGSVPTCPSDEFRCRNGRCIPRAWRCDGVNDCADNSDEEDCTEHT

SEQ ID NO: 835 - protein, 120 aa, Artificial Sequence
  Description of Artificial Sequence: Synthetic polypeptide
CLANQFKCDNGRCIPQTWVCDGDNDCLDGSDEPVHCAERTCPSSQFQCSSGWCISQRWVCDGENDCEDGSDEANCAGSVPTCPSDEFRCRNGRCIPRAWRCDGVNDCADNSDEEDCTEHT

SEQ ID NO: 836 - protein, 120 aa, Artificial Sequence
  Description of Artificial Sequence: Synthetic polypeptide
CLANQFKCDNGRCIPQTWVCDGDNDCLDGSDEPVRCAKRTCPSSQFQCSSGWCISQRWVCDGENDCEDGSDEANCAGSVPTCPSDEFRCRNGRCIPRAWRCDGVNDCADNSDEEGCTPHT

SEQ ID NO: 837 - protein, 120 aa, Artificial Sequence
  Description of Artificial Sequence: Synthetic polypeptide
CLANQFKCDNGRCIPQTWVCDGDNDCLDGSDEPVHCAKRTCPSSQFQCSSGWCISQRWVCDGENDCEDGSDEANCAGSVPTCPSDEFRCRNGRCIPRAWRCDGVNDCADNSDEADCKAHT

SEQ ID NO: 838 - protein, 120 aa, Artificial Sequence
  Description of Artificial Sequence: Synthetic polypeptide
CLANQFKCDNGRCIPQTWVCDGDNDCLDGSDEPVHCAKRTCPSSQFQCGSGWCISQHWVCDGENDCEDGSDEANCAGSVPTCPSDEFRCRNGRCIPRAWRCDGVNDCGDNSDETNCAPPT

SEQ ID NO: 839 - protein, 122 aa, Artificial Sequence
  Description of Artificial Sequence: Synthetic polypeptide
CLSSEFTCGNGNCIPQTWVCDGDNDCLDGSDEPVHCAKRTCPSSQFQCSSGWCISQRWVCDGENDCEDSSDEANCAGSVPTCPSSQFRRNNGHCLSVTLVCDGDNDCEDDSDETGCEGSGHT

SEQ ID NO: 840 - protein, 124 aa, Artificial Sequence
  Description of Artificial Sequence: Synthetic polypeptide
  MOD_RES (3)..(3): Ala or Ser
  MOD_RES (4)..(4): Variable amino acid
  MOD_RES (5)..(5): Glu or Gln
  MOD_RES (7)..(7): Variable amino acid
  MOD_RES (9)..(9): Variable amino acid
  MOD_RES (12)..(13): Variable amino acid
  MOD_RES (35)..(35): Variable amino acid
  MOD_RES (38)..(38): Glu, Lys or Gln
  MOD_RES (49)..(49): Variable amino acid
  MOD_RES (57)..(57): Variable amino acid
  MOD_RES (69)..(69): Variable amino acid
  MOD_RES (85)..(85): Variable amino acid
  MOD_RES (86)..(86): Glu or Gln
  MOD_RES (89)..(90): Variable amino acid
  MOD_RES (93)..(93): Variable amino acid
  MOD_RES (95)..(95): Ile, Leu or Val
  MOD_RES (96)..(97): Variable amino acid
  MOD_RES (98)..(98): Ala, Ser or Thr
  MOD_RES (99)..(100): Variable amino acid
  MOD_RES (104)..(104): Variable amino acid
  MOD_RES (108)..(108): Variable amino acid
  MOD_RES (110)..(110): Asp or Asn
  MOD_RES (114)..(115): Variable amino acid
  MOD_RES (117)..(117): Variable amino acid
  MOD_RES (118)..(118): Variable amino acid that may or may not be present
  MOD_RES (119)..(119): Variable amino acid
  MOD_RES (120)..(120): Variable amino acid that may or may not be present
  MOD_RES (121)..(123): Variable amino acid
CLXXXFXCXNGXXIPQTWVCDGDNDCLDGSDEPVXCAXRTCPSSQFQCXSGWCISQXWVCDGENDCEDXSDEANCAGSVPTCPSXXFRXXNGXCXXXXXXCDGXNDCXDXSDEXXCXXXXXXXT

SEQ ID NO: 841 - protein, 124 aa, Artificial Sequence
  Description of Artificial Sequence: Synthetic polypeptide
  MOD_RES (13)..(13): Variable amino acid
  MOD_RES (35)..(35): Variable amino acid
  MOD_RES (38)..(38): Glu, Lys or Gln
  MOD_RES (49)..(49): Variable amino acid
  MOD_RES (57)..(57): Variable amino acid
  MOD_RES (69)..(69): Variable amino acid
  MOD_RES (108)..(108): Variable amino acid
  MOD_RES (114)..(115): Variable amino acid
  MOD_RES (117)..(117): Variable amino acid
  MOD_RES (118)..(118): Variable amino acid that may or may not be present
  MOD_RES (119)..(119): Variable amino acid
  MOD_RES (120)..(120): Variable amino acid that may or may not be present
  MOD_RES (121)..(123): Variable amino acid
CLANQFKCDNGRXIPQTWVCDGDNDCLDGSDEPVXCAXRTCPSSQFQCXSGWCISQXWVCDGENDCEDXSDEANCAGSVPTCPSDEFRCRNGRCIPRAWRCDGVNDCXDNSDEXXCXXXXXXXT

SEQ ID NO: 842 - protein, 124 aa, Artificial Sequence
  Description of Artificial Sequence: Synthetic polypeptide
  MOD_RES (13)..(13): Variable amino acid
  MOD_RES (35)..(35): Variable amino acid
  MOD_RES (38)..(38): Glu, Lys or Gln
  MOD_RES (69)..(69): Variable amino acid
  MOD_RES (114)..(115): Variable amino acid
  MOD_RES (117)..(117): Variable amino acid
  MOD_RES (118)..(118): Variable amino acid that may or may not be present
  MOD_RES (119)..(119): Variable amino acid
  MOD_RES (120)..(120): Variable amino acid that may or may not be present
  MOD_RES (121)..(122): Variable amino acid
CLANQFKCDNGRXIPQTWVCDGDNDCLDGSDEPVXCAXRTCPSSQFQCSSGWCISQRWVCDGENDCEDXSDEANCAGSVPTCPSDEFRCRNGRCIPRAWRCDGVNDCADNSDEXXCXXXXXXHT

SEQ ID NO: 843 - protein, 80 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDSSDEANCAGSVPT

SEQ ID NO: 844 - protein, 126 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDSSDEANCAGSVPTCQPGQFRCNNGHCLSQPLVCDGVPDCEDGSDEASCSAPASEPPGSL

SEQ ID NO: 845 - protein, 123 aa, Artificial Sequence
  Description of Artificial Sequence: Synthetic polypeptide
CLPDQFRCGNGQCIPLDWVCDGVNDCEDDSDEESCPPRTCLPDQFQCGSGYCLPQRWVCDGENDCEDSSDEANCAGSVPTCASSQFPCDNGKCLPPPLVCDGVDDCGDDSDEPSAPCGSPART

SEQ ID NO: 846 - protein, 121 aa, Artificial Sequence
  Description of Artificial Sequence: Synthetic polypeptide
CLPDQFRCGNGQCIPLDWVCDGVNDCVDGSDEAGCPPRTCLPDQFQCGSGYCLPQRWVCDGENDCEDGSDEANCAGSVPTCRPDEFKCENGHCIPPGLRCDGVDDCVDNSDETDCETPGRT

SEQ ID NO: 847 - protein, 119 aa, Artificial Sequence
  Description of Artificial Sequence: Synthetic polypeptide
CLPDQFRCGNGQCIPLDWVCDGVNDCGDNSDEAGCPTRTCLPSQFQCGSGYCISQRWVCDGENDCEDSSDEANCAGSVPTCLPGQFRCDNGQCIPAHWGCDGVNDCRDNSDEADCPQPT

SEQ ID NO: 848 - protein, 128 aa, Artificial Sequence
  Description of Artificial Sequence: Synthetic polypeptide
CLSSEFTCGNGNCIPRPWVCDGDNDCVDDSDEKGCPEPTCLPSQFQCGSGYCISQRWVCDGENDCEDSSDEANCAGSVPTCEADQFQCGSGYCLPRHWVCDGDNDCEDDSDETDCGRPGPGATSAPAV

SEQ ID NO: 849 - protein, 121 aa, Artificial Sequence
  Description of Artificial Sequence: Synthetic polypeptide
CLSSEFTCGNGNCIPRPWVCDGDNDCVDDSDEKGCPEPTCLPSQFQCGSGYCISQRWVCDGENDCEDSSDEANCAGSVPTCAPNQFQCGSGYCVPAAWVCDGENDCEDNSDESSALCQERT

SEQ ID NO: 850 - protein, 120 aa, Artificial Sequence
  Description of Artificial Sequence: Synthetic polypeptide
CLPSEFQCRDSKICLSADWLCDGVNDCVDGSDEAGCPPRTCLPDQFQCGSGYCISQRWVCDGENDCEDSSDEANCAGSVPTCRASQFQCGSGYCIPRPWLCDGDNDCEDDSDETNCTPRT

SEQ ID NO: 851 - protein, 122 aa, Artificial Sequence
  Description of Artificial Sequence: Synthetic polypeptide
CVSSQFQCGNGHCVPAQWLCDGVNDCGDNSDEASCPPRTCAPSQFQCGSGYCIPLTWVRDGVDDCEDGSDEEDCSQDPEFHKVCLADQFQCNNGRCVPQSWGCDGDDDCQDNSDETSCAPPT

SEQ ID NO: 852 - protein, 131 aa, Artificial Sequence
  Description of Artificial Sequence: Synthetic polypeptide
  MOD_RES (2)..(2): Ile, Leu or Val
  MOD_RES (3)..(4): Variable amino acid
  MOD_RES (5)..(5): Glu or Gln
  MOD_RES (7)..(7): Variable amino acid
  MOD_RES (9)..(9): Variable amino acid
  MOD_RES (10)..(10): Asp or Asn
  MOD_RES (11)..(12): Variable amino acid
  MOD_RES (13)..(13): Variable amino acid that may or may not be present
  MOD_RES (14)..(14): Variable amino acid
  MOD_RES (16)..(16): Ile, Leu or Val
  MOD_RES (17)..(19): Variable amino acid
  MOD_RES (21)..(21): Ile, Leu or Val
  MOD_RES (25)..(25): Variable amino acid
  MOD_RES (29)..(29): Variable amino acid
  MOD_RES (31)..(31): Variable amino acid
  MOD_RES (35)..(36): Variable amino acid
  MOD_RES (39)..(40): Variable amino acid
  MOD_RES (43)..(43): Variable amino acid
  MOD_RES (45)..(45): Variable amino acid
  MOD_RES (55)..(55): Ile, Leu or Val
  MOD_RES (56)..(58): Variable amino acid
  MOD_RES (61)..(61): Variable amino acid
  MOD_RES (64)..(64): Variable amino acid
  MOD_RES (65)..(65): Asp or Asn
  MOD_RES (70)..(70): Variable amino acid
  MOD_RES (74)..(74): Variable amino acid
  MOD_RES (75)..(75): Asp or Asn
  MOD_RES (77)..(77): Ala or Ser
  MOD_RES (78)..(80): Variable amino acid
  MOD_RES (81)..(81): Variable amino acid that may or may not be present
  MOD_RES (82)..(82): Variable amino acid
  MOD_RES (83)..(83): Variable amino acid that may or may not be present
  MOD_RES (84)..(84): Variable amino acid
  MOD_RES (85)..(85): Variable amino acid that may or may not be present
  MOD_RES (86)..(88): Variable amino acid
  MOD_RES (90)..(92): Variable amino acid
  MOD_RES (93)..(93): Glu or Gln
  MOD_RES (95)..(95): Variable amino acid
  MOD_RES (97)..(98): Variable amino acid
  MOD_RES (100)..(100): Variable amino acid
  MOD_RES (102)..(102): Ile, Leu or Val
  MOD_RES (103)..(107): Variable amino acid
  MOD_RES (111)..(112): Variable amino acid
  MOD_RES (115)..(115): Variable amino acid
  MOD_RES (117)..(117): Variable amino acid
  MOD_RES (121)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
  MOD_RES (128)..(131): Variable amino acid
CXXXXFXCXXXXXXCXXXXWXCDGXNDCXDXSDEXXCPXXTCXPXQFQCGSGYCXXXXWVXDGXXDCEDXSDEXXCXXXXXXXXXXXXCXXXXFXCXXGXCXXXXXXCDGXXDCXDXSDEXXXXXXCXXXX

SEQ ID NO: 853 - protein, 131 aa, Artificial Sequence
  Description of Artificial Sequence: Synthetic polypeptide
  MOD_RES (3)..(4): Variable amino acid
  MOD_RES (5)..(5): Glu or Gln
  MOD_RES (7)..(7): Variable amino acid
  MOD_RES (9)..(9): Variable amino acid
  MOD_RES (10)..(10): Asp or Asn
  MOD_RES (11)..(12): Variable amino acid
  MOD_RES (13)..(13): Variable amino acid that may or may not be present
  MOD_RES (14)..(14): Variable amino acid
  MOD_RES (16)..(16): Ile, Leu or Val
  MOD_RES (17)..(19): Variable amino acid
  MOD_RES (21)..(21): Ile, Leu or Val
  MOD_RES (25)..(25): Variable amino acid
  MOD_RES (29)..(29): Variable amino acid
  MOD_RES (31)..(31): Variable amino acid
  MOD_RES (35)..(36): Variable amino acid
  MOD_RES (39)..(40): Variable amino acid
  MOD_RES (45)..(45): Variable amino acid
  MOD_RES (55)..(55): Ile, Leu or Val
  MOD_RES (56)..(56): Variable amino acid
  MOD_RES (70)..(70): Variable amino acid
  MOD_RES (80)..(80): Variable amino acid
  MOD_RES (81)..(81): Variable amino acid that may or may not be present
  MOD_RES (82)..(82): Variable amino acid
  MOD_RES (83)..(83): Variable amino acid that may or may not be present
  MOD_RES (84)..(84): Variable amino acid
  MOD_RES (85)..(85): Variable amino acid that may or may not be present
  MOD_RES (90)..(92): Variable amino acid
  MOD_RES (93)..(93): Glu or Gln
  MOD_RES (95)..(95): Variable amino acid
  MOD_RES (97)..(98): Variable amino acid
  MOD_RES (100)..(100): Variable amino acid
  MOD_RES (102)..(102): Ile, Leu or Val
  MOD_RES (103)..(107): Variable amino acid
  MOD_RES (111)..(112): Variable amino acid
  MOD_RES (115)..(115): Variable amino acid
  MOD_RES (117)..(117): Variable amino acid
  MOD_RES (121)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
  MOD_RES (128)..(131): Variable amino acid
CLXXXFXCXXXXXXCXXXXWXCDGXNDCXDXSDEXXCPXXTCLPXQFQCGSGYCXXQRWVCDGENDCEDXSDEANCAGSXXXXXXVPTCXXXXFXCXXGXCXXXXXXCDGXXDCXDXSDEXXXXXXCXXXX

SEQ ID NO: 854 - protein, 131 aa, Artificial Sequence
  Description of Artificial Sequence: Synthetic polypeptide
  MOD_RES (3)..(4): Variable amino acid
  MOD_RES (5)..(5): Glu or Gln
  MOD_RES (7)..(7): Variable amino acid
  MOD_RES (12)..(12): Variable amino acid
  MOD_RES (13)..(13): Variable amino acid that may or may not be present
  MOD_RES (14)..(14): Variable amino acid
  MOD_RES (18)..(19): Variable amino acid
  MOD_RES (25)..(25): Variable amino acid
  MOD_RES (29)..(29): Variable amino acid
  MOD_RES (31)..(31): Variable amino acid
  MOD_RES (35)..(36): Variable amino acid
  MOD_RES (39)..(40): Variable amino acid
  MOD_RES (45)..(45): Variable amino acid
  MOD_RES (55)..(55): Ile, Leu or Val
  MOD_RES (56)..(56): Variable amino acid
  MOD_RES (70)..(70): Variable amino acid
  MOD_RES (80)..(80): Variable amino acid
  MOD_RES (81)..(81): Variable amino acid that may or may not be present
  MOD_RES (82)..(82): Variable amino acid
  MOD_RES (83)..(83): Variable amino acid that may or may not be present
  MOD_RES (84)..(84): Variable amino acid
  MOD_RES (85)..(85): Variable amino acid that may or may not be present
  MOD_RES (90)..(92): Variable amino acid
  MOD_RES (93)..(93): Glu or Gln
  MOD_RES (95)..(95): Variable amino acid
  MOD_RES (97)..(98): Variable amino acid
  MOD_RES (100)..(100): Variable amino acid
  MOD_RES (102)..(102): Ile, Leu or Val
  MOD_RES (103)..(107): Variable amino acid
  MOD_RES (111)..(112): Variable amino acid
  MOD_RES (115)..(115): Variable amino acid
  MOD_RES (117)..(117): Variable amino acid
  MOD_RES (121)..(123): Variable amino acid
  MOD_RES (124)..(124): Variable amino acid that may or may not be present
  MOD_RES (125)..(125): Variable amino acid
  MOD_RES (126)..(126): Variable amino acid that may or may not be present
  MOD_RES (128)..(131): Variable amino acid
CLXXXFXCGNGXXXCIPXXWVCDGXNDCXDXSDEXXCPXXTCLPXQFQCGSGYCXXQRWVCDGENDCEDXSDEANCAGSXXXXXXVPTCXXXXFXCXXGXCXXXXXXCDGXXDCXDXSDEXXXXXXCXXXX

SEQ ID NO: 855 - protein, 119 aa, Artificial Sequence; identical to SEQ ID NO: 21
  Description of Artificial Sequence: Synthetic polypeptide

SEQ ID NO: 856 - protein, 119 aa, Artificial Sequence
  Description of Artificial Sequence: Synthetic polypeptide
CLPDQFRCGNGQCMPLDWVCDGVYDCPDDSDEEGCPPRTCAQSKFQCGSGYCISQRWVCDGEYDCEDGSDEANCADSVPTCPSDEFRCRNGRCIPRGWRCDGVNDCADSSDEEDCTENP

SEQ ID NO: 857 - protein, 119 aa, Artificial Sequence
  Description of Artificial Sequence: Synthetic polypeptide
CLSVQFRCGNGQCIPLDWVCDGVKDCPDDSDEEGCPPWTCAPSQFQCGSGYCISQRWVCDGESDCEDGSDEANCAGSVPTCPSDEFRCRNGRCIPRGWLCDGVNDCADNSDEEDCTDNT

SEQ ID NO: 858 - protein, 119 aa, Artificial Sequence
  Description of Artificial Sequence: Synthetic polypeptide
CLPDQFRCGNGQCIPLDWVCDGVNDCPDDSDEEGCPPRTCAPSQFQCGSGWCISTRWVCDGENDCEDGSDEANCPGTVPTCPSDEFRCKNGRCVPRSWCCDGVNDCADNSDEEDCTDPT

SEQ ID NO: 859 - protein, 119 aa, Artificial Sequence
  Description of Artificial Sequence: Synthetic polypeptide
CLPDQFRCGNGQCIPLDWVCDGVSDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 860 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSGEFRCRNGRCIPRAWRCDGVNDCADNSDEEDCTEHT

SEQ ID NO: 861 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGCCIPRAWRCDGVNDCTDNSDEGDCTEHT

SEQ ID NO: 862 - protein, 119 aa, Artificial Sequence
  Description of Artificial Sequence: Synthetic polypeptide
CLSDQFRCGNGDCIRLDWVCDGVNDCTDDSDEEGCPQRSCAPSQFQCGSGYCISQGWVCDGENDCEDGSDEANCAGCVPTCRSDEFRCRNGRCIPLAWRCDGVNDCVDNSDEEDCPEHT

SEQ ID NO: 863 - protein, 119 aa, Artificial Sequence
  Description of Artificial Sequence: Synthetic polypeptide
  MOD_RES (29)..(29): Variable amino acid
  MOD_RES (33)..(34): Variable amino acid
  MOD_RES (41)..(41): Variable amino acid
  MOD_RES (49)..(50): Variable amino acid
  MOD_RES (63)..(63): Variable amino acid
CLPDQFRCGNGQCIPLDWVCDGVNDCADXSDEXXCPTRTCXPSQFQCGXXYCISQRWVCDGEXDCEDGSDEANCAGSVPTCPSDEFRCRNGRCIPRAWRCDGVNDCADNSDEEDCTEHT

SEQ ID NO: 864 - protein, 119 aa, Artificial Sequence
  Description of Artificial Sequence: Synthetic polypeptide
CPSDKFRCGNGQCIPLDWVCDGVNDCPDDSDEEGCPPRTCAPSQFQCGSGYCISQRWVCDGENDCEDGSDEANCAGSVPTCPSDEFRCRNGQCIPLDWVCDGVNDCPDDSDEEDCTEHT

SEQ ID NO: 865 - protein, 119 aa, Artificial Sequence
  Description of Artificial Sequence: Synthetic polypeptide
CPSDEFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHT

SEQ ID NO: 866 - protein, 119 aa, Artificial Sequence
  Description of Artificial Sequence: Synthetic polypeptide
  MOD_RES (33)..(33): Variable amino acid
  MOD_RES (62)..(62): Variable amino acid
  MOD_RES (89)..(89): Variable amino acid
  MOD_RES (113)..(114): Variable amino acid
CPSDEFRCGNGQCIPLDWVCDGVNDCPDDSDEXGCPPRTCAPSQFQCGSGYCISQRWVCDGXNDCEDGSDEANCAGSVPTCPSDEFRCXNGRCIPRAWRCDGVNDCADNSDEXXCTEHT

SEQ ID NO: 867 - protein, 119 aa, Artificial Sequence
  Description of Artificial Sequence: Synthetic polypeptide
CPPDQFRCGNGQCIPLDWVCDGVHDCPDDSDEEGCPPRTCAPSQFQCGSGYCISQRWVCDGENDCEDGSDEANCAGSVPTCPWNEFRCRNGRCIPWSWRCDGVNDCADNSDEEECTEHT

SEQ ID NO: 868 - protein, 119 aa, Artificial Sequence; identical to SEQ ID NO: 15
  Description of Artificial Sequence: Synthetic polypeptide

SEQ ID NO: 869 - protein, 119 aa, Artificial Sequence
  Description of Artificial Sequence: Synthetic polypeptide
CLPDQFRCGNGQCIPLDWVCDGVNDCADNSDETSCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 870 - protein, 119 aa, Artificial Sequence
  Description of Artificial Sequence: Synthetic polypeptide
CLPDQFRCGNGQCTPLDWVCDGVNDCPDDSDEEGCPPRTCAPSQFQCGSGYCIPQRWVCDGENDCEDGSDEANCAGSVPTCPSGEFQCSNGRCIPWAWRCDGVNDCADNSDEEDCTEPP

SEQ ID NO: 871 - protein, 119 aa, Artificial Sequence
  Description of Artificial Sequence: Synthetic polypeptide
CLPDQFRCGNGQCIPLDWVCDGVNDCPDDSDEEGCPPRTCPPSQFQCGSGYCITERWVCDGENDCEDGSDEANCAGSVPTCSSDEFRCRAGTCIPRAWCCDGVKDCADNSDEEDCTENT

SEQ ID NO: 872 - protein, 119 aa, Artificial Sequence; identical to SEQ ID NO: 15
  Description of Artificial Sequence: Synthetic polypeptide

SEQ ID NO: 873 - protein, 119 aa, Artificial Sequence
  Description of Artificial Sequence: Synthetic polypeptide
  MOD_RES (33)..(33): Variable amino acid
  MOD_RES (62)..(62): Variable amino acid
  MOD_RES (70)..(70): Variable amino acid
CLPDEFQCGNGQCISLDWVCDGVNDCPDDSDEXGCPPSSCPPNQFQCGSGYCISQRWVCDGXNDCEDGSXEANCAGSVPACPSDEFRCRDGRCIPRAWLCDGINDCADNSDEEDCTEHT

SEQ ID NO: 874 - protein, 119 aa, Artificial Sequence
  Description of Artificial Sequence: Synthetic polypeptide
CLAHQFLCGNGQCLPLDWVCDGVTDCPDDSDEVGCPPRTCAPSHFQCGSGYCISQSWVCDGEYDCEDGSDEASCAGSVPSCPSDEFQCRNGRCIPRPWRCDGVNDCADNSDEEDCTEHT

SEQ ID NO: 875 - protein, 119 aa, Artificial Sequence; identical to SEQ ID NO: 15
  Description of Artificial Sequence: Synthetic polypeptide

SEQ ID NO: 876 - protein, 119 aa, Artificial Sequence; identical to SEQ ID NO: 15
  Description of Artificial Sequence: Synthetic polypeptide

SEQ ID NO: 877 - protein, 121 aa, Artificial Sequence
  Description of Artificial Sequence: Synthetic polypeptide
CQANEFTCSSGNCLSPALLCDGVDDCGDNSDEAYCASPAPTCLPSQFQCGSGYCISQRWVCDGENDCEDSSDEANCAGSVPTCQPGEFTCESGRCLPLRWLCDGEDDCVDSSDEASCQPPT

SEQ ID NO: 878 - protein, 121 aa, Artificial Sequence; identical to SEQ ID NO: 877
  Description of Artificial Sequence: Synthetic polypeptide

SEQ ID NO: 879 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRGWRCDGVNDCADTSDEEDCKEHC

SEQ ID NO: 880 - protein, 119 aa, Artificial Sequence; identical to SEQ ID NO: 15
  Description of Artificial Sequence: Synthetic polypeptide

SEQ ID NO: 881 - protein, 119 aa, Artificial Sequence; identical to SEQ ID NO: 15
  Description of Artificial Sequence: Synthetic polypeptide

SEQ ID NO: 882 - protein, 119 aa, Artificial Sequence
  Description of Artificial Sequence: Synthetic polypeptide
CLPDQFRCGNGKCIPLDWVCDGVNDCPDASDEEGCPPRTCGPSQFQCGSGYCISQGWVCDGEIDCEDSSDEANCAGSVPTCPSDQFQCSNGRCIPRAWHCDGINDCEDNSDEEDCTEHT

SEQ ID NO: 883 - protein, 119 aa, Artificial Sequence
  Description of Artificial Sequence: Synthetic polypeptide
CLPGQFRCANGQCIPLEWVCDGDNDCPDDSDEDGCPPRTCGPSQFKCGSGYCISESWVCDGEYDCEDGSDEATCVGSVPTCPWDEFRCRSGRCISRAWRCDGVNDCADNSDEEACTDHT

SEQ ID NO: 884 - protein, 119 aa, Artificial Sequence
  Description of Artificial Sequence: Synthetic polypeptide
CLSDQFRCGEGQCIPLDWVCDGVSDCGDDSDEEGCPPSTCAPSQFQCGSGYCISQNWVCDGENDCEDGSDEANCAGCVPTCPADEFRCRDGRCIPRAWRCDGVNDCGDKSDEEDCTENT

SEQ ID NO: 885 - protein, 119 aa, Artificial Sequence
  Description of Artificial Sequence: Synthetic polypeptide
CRPDQFRCGNGHCIPLDWVCDGVNDCTDDSDEGGCPQRSCAPRQFQCGSGYCISQRWVCDGEYDCEDGSDEANCTGSVAACPYDEFRCINGRCIPRSWCCDGVNDCADNSDEADCPEHT

SEQ ID NO: 886 - protein, 119 aa, Artificial Sequence
  Description of Artificial Sequence: Synthetic polypeptide
CLPDEFRCGNGHCIPLDWVCDGVNDCPDDSDEEGCPPQTCAPSQFQCGSGFCISQRWVCDGEQDCVDGSDESNCADSVPTCPSDEFRCKNGRCIPLVWRCDGVNDCSDNSDEEDCKVHS

SEQ ID NO: 887 - protein, 103 aa, Artificial Sequence
  Description of Artificial Sequence: Synthetic polypeptide
  MOD_RES (50)..(50): Variable amino acid
  MOD_RES (71)..(72): Variable amino acid
  MOD_RES (85)..(85): Variable amino acid
  MOD_RES (102)..(103): Variable amino acid
CRRDQFRCGNGQCISVDWVCDGVNDCPDESDEEGCPPRTCTPSQFMCGSXYCISQRWVCDGEYDCEDGSDXXNCAGSVPTCPKDXFQCRNGRCIPRAWGCDXX

SEQ ID NO: 888 - protein, 119 aa, Artificial Sequence
  Description of Artificial Sequence: Synthetic polypeptide
  MOD_RES (1)..(5): Variable amino acid
  MOD_RES (9)..(10): Variable amino acid
  MOD_RES (12)..(23): Variable amino acid
  MOD_RES (29)..(29): Variable amino acid
  MOD_RES (33)..(34): Variable amino acid
  MOD_RES (41)..(42): Variable amino acid
  MOD_RES (71)..(72): Variable amino acid
  MOD_RES (74)..(79): Variable amino acid
  MOD_RES (82)..(82): Variable amino acid
  MOD_RES (84)..(84): Variable amino acid
  MOD_RES (89)..(90): Variable amino acid
  MOD_RES (113)..(113): Variable amino acid
XXXXXFPGXXRXXXXXXXXXXXXYDCLDXSDEXXCPARTCXXSQFQCGSGYCISQRWVCDGEYDCEDGSDXXNXXXXXXTCXSXEFRCXXGRCIPRSWRCDGVNDCADNSDEXDCTGHS

SEQ ID NO: 889 - protein, 119 aa, Artificial Sequence
  Description of Artificial Sequence: Synthetic polypeptide
CLPGQFRCGNGQCIPLDWVCDGVNDCPDDSDEEGCPPRTCAPNQFQCGSGYCISQRWVCDGENDCEDGSDEANCVGSVTTCPSDEFRCRNGRCIPRVWRCDGEDDCADNSDEEDCTECT

SEQ ID NO: 890 - protein, 136 aa, Artificial Sequence
  Description of Artificial Sequence: Synthetic polypeptide
  MOD_RES (3)..(3): Variable amino acid
  MOD_RES (5)..(5): Variable amino acid
  MOD_RES (15)..(15): Variable amino acid
  MOD_RES (17)..(17): Variable amino acid
  MOD_RES (19)..(23): Variable amino acid
  MOD_RES (25)..(30): Variable amino acid
  MOD_RES (32)..(32): Variable amino acid
  MOD_RES (34)..(36): Variable amino acid
  MOD_RES (40)..(45): Variable amino acid
  MOD_RES (47)..(47): Variable amino acid
  MOD_RES (52)..(54): Variable amino acid
  MOD_RES (58)..(60): Variable amino acid
  MOD_RES (62)..(62): Variable amino acid
  MOD_RES (64)..(66): Variable amino acid
  MOD_RES (69)..(69): Variable amino acid
  MOD_RES (76)..(76): Variable amino acid
  MOD_RES (78)..(79): Variable amino acid
  MOD_RES (81)..(83): Variable amino acid
  MOD_RES (85)..(85): Variable amino acid
  MOD_RES (88)..(90): Variable amino acid
  MOD_RES (92)..(92): Variable amino acid
  MOD_RES (94)..(94): Variable amino acid
  MOD_RES (96)..(96): Variable amino acid
  MOD_RES (98)..(98): Variable amino acid
  MOD_RES (100)..(103): Variable amino acid
  MOD_RES (105)..(105): Variable amino acid
  MOD_RES (107)..(107): Variable amino acid
  MOD_RES (109)..(114): Variable amino acid
  MOD_RES (119)..(119): Variable amino acid
  MOD_RES (121)..(125): Variable amino acid
  MOD_RES (127)..(130): Variable amino acid
  MOD_RES (132)..(134): Variable amino acid
CLXYXFLCVNGQCIXWXCXXXXXLXXXXXXKXLXXXYLCXXXXXXRXRLLHXXXLGLXXXKXLXXXLGXNKLCWPXTXXSXXXVXVQXXXLXPXCXAXRXXXXLXGXLXXXXXXRTHFXAXXXXXPXXXXPXXXPL

SEQ ID NO: 891 - protein, 119 aa, Artificial Sequence
  Description of Artificial Sequence: Synthetic polypeptide
  MOD_RES (2)..(2): Variable amino acid
  MOD_RES (9)..(10): Variable amino acid
  MOD_RES (34)..(34): Variable amino acid
  MOD_RES (41)..(41): Variable amino acid
  MOD_RES (48)..(48): Variable amino acid
  MOD_RES (56)..(56): Variable amino acid
  MOD_RES (80)..(80): Variable amino acid
  MOD_RES (87)..(87): Variable amino acid
  MOD_RES (107)..(107): Variable amino acid
  MOD_RES (114)..(114): Variable amino acid
CXPDQFRCXXGQCIPLDWVCDGVNDCPDNSDEKXCPPRTCXPSQFQCXSGYCISQXWVCDGENDCEDGSDEANCAGSVPXCPSDEFXCRNGLCIPRAWRCDGVNDCXDNSDEEXCTEHT

SEQ ID NO: 892 - protein, 119 aa, Artificial Sequence
  Description of Artificial Sequence: Synthetic polypeptide
CLPNQFRCRNGQCIPLDWVCDGINDCPDESDEEGCPPRTCAPSQFQCGSGYCISRRWVCDGEIDCDDGSDEANCAGSVPACPSDEFRCSNCRCIPRAWRCDGVNDCSDNSDEEDCTGHT

SEQ ID NO: 893 - protein, 110 aa, Artificial Sequence
  Description of Artificial Sequence: Synthetic polypeptide
  MOD_RES (66)..(66): Variable amino acid
  MOD_RES (71)..(72): Variable amino acid
  MOD_RES (79)..(79): Variable amino acid
  MOD_RES (85)..(85): Variable amino acid
  MOD_RES (89)..(89): Variable amino acid
  MOD_RES (101)..(101): Variable amino acid
  MOD_RES (103)..(103): Variable amino acid
  MOD_RES (105)..(105): Variable amino acid
CLPAQFRCGNGQCIPLDWVCDGVNDCADNSDETGCPTRTCLPSQFQCGSGYCISQRWVCDGENDCXDGSDXXNCAGSVXTCPSDXFRCXNGRCIPRAWRCXGXNXCGGQL

SEQ ID NO: 894 - protein, 138 aa, Artificial Sequence
  Description of Artificial Sequence: Synthetic polypeptide
  MOD_RES (1)..(2): Variable amino acid
  MOD_RES (9)..(10): Variable amino acid
  MOD_RES (12)..(12): Variable amino acid
  MOD_RES (17)..(17): Variable amino acid
  MOD_RES (26)..(30): Variable amino acid
  MOD_RES (32)..(33): Variable amino acid
  MOD_RES (35)..(47): Variable amino acid
  MOD_RES (49)..(49): Variable amino acid
  MOD_RES (51)..(52): Variable amino acid
  MOD_RES (54)..(59): Variable amino acid
  MOD_RES (63)..(67): Variable amino acid
  MOD_RES (69)..(72): Variable amino acid
  MOD_RES (74)..(75): Variable amino acid
  MOD_RES (78)..(78): Variable amino acid
  MOD_RES (80)..(81): Variable amino acid
  MOD_RES (83)..(85): Variable amino acid
  MOD_RES (87)..(88): Variable amino acid
  MOD_RES (90)..(92): Variable amino acid
  MOD_RES (94)..(101): Variable amino acid
  MOD_RES (103)..(106): Variable amino acid
  MOD_RES (112)..(112): Variable amino acid
  MOD_RES (115)..(116): Variable amino acid
  MOD_RES (119)..(120): Variable amino acid
  MOD_RES (125)..(126): Variable amino acid
  MOD_RES (138)..(138): Variable amino acid
XXSDQFLCXXGXCIPLXWVCDGIHDXXXXXEXXRXXXXXXXXXXXXXRXRXXLXXXXXXQRQXXXXXRXXXXKXXSFXTXXPXXXFXXQXXXLXXXXXXXXRXXXXCEQLEXKQXXSAXXFAKGXXGPQAPPPPPPPX

SEQ ID NO: 895 - protein, 119 aa, Artificial Sequence
  Description of Artificial Sequence: Synthetic polypeptide
CLQDQFRCGDGQCIPLEWVCDGVDDCADHSDEEGCPPRTCSPSQFQCGSGYCISQRWVCDGENDCEDGSDEANCPGSVPTCPSDEFRCRNGRCIPRAWRCDGVSDCADNSDEEDCTEET

SEQ ID NO: 896 - protein, 119 aa, Artificial Sequence
  Description of Artificial Sequence: Synthetic polypeptide
  MOD_RES (114)..(114): Variable amino acid
CLPDQFRCGNGECIPLDWVCDGVKDCPDDSDEEGCPPPTCAPGQFQCGSGYCISKRWVCDGENDCEDGSDEANCEGSVPACPSDEFRCGNGRCIPRDWRCDGVHDCEDNSDEEXCTEHN

SEQ ID NO: 897 - protein, 119 aa, Artificial Sequence
  Description of Artificial Sequence: Synthetic polypeptide
CLPDQFRCSNGHCIPLDWVCDGVNDCPDDSDEGGCPPRTCAPSQFQCGSGFCISQRWVCDGEHDCEDGSDEANCAVSIPTCPPDDFRCRNGRCIPRAWCCDGVNDCADNSDEEGCREHT

SEQ ID NO: 898 - protein, 119 aa, Artificial Sequence
  Description of Artificial Sequence: Synthetic polypeptide
CPPKQFRCGNGQCIPLDWICDGVNDCTDDSDEEGCPPRSCAPGQFQCGSGYCISQRWVCDGENDCEDGSDEANCPCSVPTCPSDEFRCRNGPCIPRAWRCDGVNDCADNSDEDDCTGHT

SEQ ID NO: 899 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGRCIPRHWCCDGVSDCPDNSDEEDCKDHT

SEQ ID NO: 900 - protein, 119 aa, Artificial Sequence; identical to SEQ ID NO: 21
  Description of Artificial Sequence: Synthetic polypeptide

SEQ ID NO: 901 - protein, 119 aa, Artificial Sequence
  Description of Artificial Sequence: Synthetic polypeptide
  MOD_RES (89)..(89): Variable amino acid
CLPYQFRCRNGRCIPLDWLCDGVNDCPDDSDEEGCPALTCAPSQFQCGSGYCISQRWVCDGEIDCEDGSDEANCAGSEPTCPSDEFRCXNGRCIPRAWCCDGVNDCVDNSDEEDCAPHT

SEQ ID NO: 902 - protein, 119 aa, Artificial Sequence
  Description of Artificial Sequence: Synthetic polypeptide
CRPDQFRCDNGHCIQLDWVCDGVNDCQDDSDEDGCPPRTCAQSQFQCGSGYCISQSWVCDGENDCEDGSDEANCAGSVPTCPSDEFRCRNGRCIPRAWRCDGINDCEDHSDEEDCKAHT

SEQ ID NO: 903 - protein, 119 aa, Artificial Sequence
  Description of Artificial Sequence: Synthetic polypeptide
  MOD_RES (92)..(92): Variable amino acid
  MOD_RES (94)..(95): Variable amino acid
  MOD_RES (99)..(99): Variable amino acid
  MOD_RES (107)..(107): Variable amino acid
  MOD_RES (114)..(114): Variable amino acid
CLPDQFRCGNGQCIPLDWVCDGVNDCPDDSDEEGCPPRTCAPSQFQCGSGYCISQRWVCDGENDCEDGSDEANCAGSVPTCPSEEFRCRNGXCXXRAWXCDGVNDCXDNSDEEXCTEHP

SEQ ID NO: 904 - protein, 119 aa, Artificial Sequence
  Description of Artificial Sequence: Synthetic polypeptide
CLPDQFRCGNGQCIPLDWVCDGVNDCADNSDETGCPTRTCLSSQFQCGSGYCISQRWVCDGENDCEDGSDEANCAGSVPTCPSDEFRCRNGRCIPRAWRCDGVNDCADNSDEEDCTEHT

SEQ ID NO: 905 - protein, 119 aa, Artificial Sequence
  Description of Artificial Sequence: Synthetic polypeptide
CLPDQFRCGNGQCIPLDWACDGVNDCADNSDETGCPTRTCLPSQFQCGSGYCISQRWVCDGENDCEDGSDEANCAGSVPTCPSDEFRCRNGRCIPRAWRCDGVNDCADNSDEEDCTEHT

SEQ ID NO: 906 - protein, 119 aa, Artificial Sequence; identical to SEQ ID NO: 15
  Description of Artificial Sequence: Synthetic polypeptide

SEQ ID NO: 907 - protein, 119 aa, Artificial Sequence; identical to SEQ ID NO: 14
  Description of Artificial Sequence: Synthetic polypeptide

SEQ ID NO: 908 - protein, 119 aa, Artificial Sequence
  Description of Artificial Sequence: Synthetic polypeptide
CLPDQFRCGNGRCIPLDWVCDGVNDCQDDSDEEGCPPRTCAPSQFQCGSGYCISQGWVCDGENDCEDGSDEANCAGPVPTCAADEFRCRNGRCIPRAWRCDGVNDCADNSDEEACTEHT

SEQ ID NO: 909 - protein, 119 aa, Artificial Sequence
  Description of Artificial Sequence: Synthetic polypeptide
CPRTSSAAATANAIHGPGFATAILICPDDSDEDGCPPRTCSPNQFQCGSGYCISQRWVCDGEIDCEDGSDEANCAGSVPKCPSDAFRCRNGRCIPRAWRCDGINDCVDNSDEEECREHT

SEQ ID NO: 910 - protein, 119 aa, Artificial Sequence; identical to SEQ ID NO: 909
  Description of Artificial Sequence: Synthetic polypeptide

SEQ ID NO: 911 - protein, 119 aa, Artificial Sequence; identical to SEQ ID NO: 15
  Description of Artificial Sequence: Synthetic polypeptide

SEQ ID NO: 912 - protein, 119 aa, Artificial Sequence
  Description of Artificial Sequence: Synthetic polypeptide
CPPEQFRCGTGKCIPMDWVCDGVKDCPDDSDEEGCPPRTCAPHQFQCGSGFCISQRWVCDGENDCEDGSDEANCAGSVPTCPSNEFRCRNGRCIPCSWHCDGVNDCADNSDEEDCTPHP

SEQ ID NO: 913 - protein, 119 aa, Artificial Sequence
  Description of Artificial Sequence: Synthetic polypeptide
CVPDQFRCGNGQCIPLDWVCDGVNDCADNSDETGCPTRTCLPSQFQCGSGYCISQRWVCDGENDCEDGSDEAHCAGSVPTCPADEFRCRNGGCIPLAWRCDGVNDCADNSDEEDCTDDT

SEQ ID NO: 914 - protein, 119 aa, Artificial Sequence; identical to SEQ ID NO: 15
  Description of Artificial Sequence: Synthetic polypeptide

SEQ ID NO: 915 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCAGSVPTCPSDEFRCRNGRCITRAWRCDGVNDCADNSDEEDCTEHT

SEQ ID NO: 916 - protein, 119 aa, Artificial Sequence; identical to SEQ ID NO: 889
  Description of Artificial Sequence: Synthetic polypeptide

SEQ ID NO: 917 - protein, 118 aa, Artificial Sequence
  Description of Artificial Sequence: Synthetic polypeptide
CPSPVPVRQRPLRSTGLGLRRRQCLSDDSDEEGCPARTCGPGQFQCGSGYCISQRWVCDGENDCEDGSDEANCAGSVPTCTSDEFRCRNGRCIPRAWRCDGVKDCADNSDEEPCKEHQ

SEQ ID NO: 918 - protein, 119 aa, Artificial Sequence
  Description of Artificial Sequence: Synthetic polypeptide
CLPDQFRCDNGQCIPLDWVCDGVNDCPDDSDEQGCPPRSCAPSQFQCGSGYCISQRWVCDGEYDCEDGSDEANCAGSAPTCPSEEFRCRNGRCIPNAWCCDGLNDCSDNSDEEDCAEHP

SEQ ID NO: 919 - protein, 119 aa, Artificial Sequence
  Description of Artificial Sequence: Synthetic polypeptide
CLPDQFRCGNGQCIPLDWICDGLIDCPDESDEEGCPPRTCEPSQFQCGSGFCISQGWVCDGEIDCEDGSDEANCAGSVPTCPSDEFRCRSGRCIPRAWRCDGISDCADGSDEEDCTEDT

SEQ ID NO: 920 - protein, 119 aa, Artificial Sequence
  Description of Artificial Sequence: Synthetic polypeptide
CAPSQFQCGSGYCISQRWVCDGENDCEDGSDEVGCPPRTCAPSQFQCGSGWCISQRWVCDGENDCEDGSDEANCAGSVPTCPSDEFRCRSGRCIPRAWRCDGVSDCADGSDEEDCTEDT

SEQ ID NO: 921 - protein, 119 aa, Artificial Sequence
  Description of Artificial Sequence: Synthetic polypeptide
CLRDQFRCGNGQCIPLDWACDGINDCPDDSDEGGCPPRMCAPSQFQCGSGYCIPLGWVCDGENDCEDGSDEANCAGSEPTCPSGEFRCRNGRCIPRAWLCDGVNDCADNSDEEDCTGHT

SEQ ID NO: 922 - protein, 119 aa, Artificial Sequence
  Description of Artificial Sequence: Synthetic polypeptide
CLPDMFRCGTRQCIPLDWVCDGVNDCADNSDETGCPTRTCLPSQFQCGSGYCISQRWVCDGENDCEDGSDEANCAGSVPTCPSDEFRCRNGRCIPRSWCCDGVNDCADNSDEEDCTEHT

SEQ ID NO: 923 - protein, 119 aa, Artificial Sequence
  Description of Artificial Sequence: Synthetic polypeptide
CLPDQFRCGNGQCIPLDWVCDGVNDCADNSDETGCPTRTCLPSQFQCGSGYCISQRWVCDGENDCEDGSDEANCADSVPTCPSYEFRCRNGRCIPRTWRCDGVNDCADNSDEEDCTEHP

SEQ ID NO: 924 - protein, 121 aa, Artificial Sequence
  Description of Artificial Sequence: Synthetic polypeptide
CLANQFKCDNGRCIPQTWVCDGDNDCLDGSDEPVHCAKRTCPSSQFQCSSGWCISQRWVCDGENDCEDNSDEANCAGSVPTCGPGQFPCNDSDRCLSVPRLCDGDDDCGDDSDEASCQPPT

SEQ ID NO: 925 - protein, 119 aa, Artificial Sequence
  Description of Artificial Sequence: Synthetic polypeptide
CLPDQFRCGNGQCMPLDWVCDGVNDCPDDSDEEGCPPRTCEPGQFQCGSGYCISQRWVCDGENDCEDGSDEATCAGSVPQCPSDEFRCRTGRCIPQAWRCDGVNDCVDNSDEECCKEHT

SEQ ID NO: 926 - protein, 81 aa, Artificial Sequence
  Description of Artificial Sequence: Synthetic polypeptide
CLANQFKCDNGRCIPQTWVCDGDNDCLDGSDEPVHCAKRTCPSSQFQCSSGWCISQRWVCDGENDCEDSSDEANCAGSVPT

SEQ ID NO: 927 - protein, 119 aa, Artificial Sequence
  Description of Artificial Sequence: Synthetic polypeptide
CVSDQFRCGNGQCLPLDWVCDGVNDCPDDSDEEGCPPLTCAPSQFQCGSGYCISQRWVCDGEYDCEDGSDEANCAGSVPTCPSDEFRCRNGRCIPRAWCCDGINDCTDNSDEEDCTEYT

SEQ ID NO: 928 - protein, 119 aa, Artificial Sequence; identical to SEQ ID NO: 909
  Description of Artificial Sequence: Synthetic polypeptide

SEQ ID NO: 929 - protein, 119 aa, Artificial Sequence
  Description of Artificial Sequence: Synthetic polypeptide
CLPDRFRCGNGQCMPMDWVCDGVNDCPDDSDERGCPPRTCAQSQFQCGSGYCISESWVCDGENDCEDGSDEANCAGSVPTCPSDEFRCSNGRCIPRSWLCDGVNDCSDNSDEEDCAEHP

SEQ ID NO: 930 - protein, 48 aa, Artificial Sequence
  Description of Artificial Sequence: Synthetic polypeptide
CHPTGQFRCRSSGRCVSPTWVCDGDNDCGDNSDEENCSAPASEPPGSL

SEQ ID NO: 931 - protein, 40 aa, Artificial Sequence
  Description of Artificial Sequence: Synthetic polypeptide
CLSSEFQCQSSGRCIPLAWVCDGDNDCRDDSDEKSCKPRT

SEQ ID NO: 932 - protein, 41 aa, Artificial Sequence
  Description of Artificial Sequence: Synthetic polypeptide
CHPTGQFRCRSSGRCVSPTWVCDGDNDCGDNSDEENCKPRT

SEQ ID NO: 933 - protein, 96 aa, Artificial Sequence
  Description of Artificial Sequence: Synthetic polypeptide
CHPTGQFRCRSSGRCVSPTWVCDGDNDCGDNSDEENCSAPASEPPGSLCHPTGQFRCRSSGRCVSPTWVCDGDNDCGDNSDEENCSAPASEPPGSL

SEQ ID NO: 934 - protein, 160 aa, Artificial Sequence
  Description of Artificial Sequence: Synthetic polypeptide
MAGPAYPYDVPDYAPGLEASGGSCLPDQFRCGNGQCIPLDWVCDGVNDCPDDSDEEGCPPRTCAPSQFQCGSGYCISQRWVCDGENDCEDGSDEANCAGSVPTCPSDEFRCRNGRCIPRAWRCDGVNDCADNSDEEDCTEHTSLQKASGALEHHHHHHHH

SEQ ID NO: 935 - protein, 160 aa, Artificial Sequence
  Description of Artificial Sequence: Synthetic polypeptide
MAGPAYPYDVPDYAPGLEASGGSCLAHQFLCGNGQCLPLDWVCDGVTDCPDDSDEVGCPPRTCAPSHFQCGSGYCISQSWVCDGEYDCEDGSDEASCAGSVPSCPSDEFQCRNGRCIPRPWRCDGVNDCADNSDEEDCTEHTSLQKASGALEHHHHHHHH

SEQ ID NO: 936 - DNA, 411 bp, Artificial Sequence
  Description of Artificial Sequence: Synthetic polynucleotide
atggccggtccggcctacccgtatgatgttccggattatgccccgggtctggaggcgtctggtggttcgtgtcaccctaccggccaatttagatgccgcagtagcggcagatgcgtttcaccgacctgggtttgcgacggcgataatgattgtggggacaactcggatgaagaaaactgtagcgcgccagcatctgaaccgccgggttccctgtgtcaccctaccggccaatttagatgccgcagtagcggcagatgcgtttcaccgacctgggtttgcgacggcgataatgattgtggggacaactcggatgaagaaaactgtagcgcgccagcatctgaaccgccgggttccctgtcattgcagaaggcctctggggccctcgagcaccaccaccaccaccaccaccac

SEQ ID NO: 937 - protein, 137 aa, Artificial Sequence
  Description of Artificial Sequence: Synthetic polypeptide
MAGPAYPYDVPDYAPGLEASGGSCHPTGQFRCRSSGRCVSPTWVCDGDNDCGDNSDEENCSAPASEPPGSLCHPTGQFRCRSSGRCVSPTWVCDGDNDCGDNSDEENCSAPASEPPGSLSLQKASGALEHHHHHHHH

SEQ ID NO: 938 - DNA, 363 bp, Artificial Sequence
  Description of Artificial Sequence: Synthetic polynucleotide
atgaaacactctggtggttcgtgtcaccctaccggccaatttagatgccgcagtagcggcagatgcgtttcaccgacctgggtttgcgacggcgataatgattgtggggacaactcggatgaagaaaactgtagcgcgccagcatctgaaccgccgggttccctgtgtcaccctaccggccaatttagatgccgcagtagcggcagatgcgtttcaccgacctgggtttgcgacggcgataatgattgtggggacaactcggatgaagaaaactgtagcgcgccagcatctgaaccgccgggttccctgtcattgcagtaggcctctggggccctcgagcaccaccaccaccaccaccaccac

SEQ ID NO: 939 - protein, 106 aa, Artificial Sequence
  Description of Artificial Sequence: Synthetic polypeptide
MKHSGGSCHPTGQFRCRSSGRCVSPTWVCDGDNDCGDNSDEENCSAPASEPPGSLCHPTGQFRCRSSGRCVSPTWVCDGDNDCGDNSDEENCSAPASEPPGSLSLQ

SEQ ID NO: 940 - protein, 96 aa, Artificial Sequence; identical to SEQ ID NO: 933
  Description of Artificial Sequence: Synthetic polypeptide

SEQ ID NO: 941 - protein, 11 aa, Artificial Sequence
  Description of Artificial Sequence: Synthetic peptide
SAPASEPPGSL

SEQ ID NO: 942 - protein, 4 aa, Artificial Sequence
  Description of Artificial Sequence: Synthetic peptide
PPRT

SEQ ID NO: 943 - protein, 6 aa, Artificial Sequence
  Description of Artificial Sequence: Synthetic peptide
AGSVPT

SEQ ID NO: 944 - protein, 23 aa, Artificial Sequence
  Description of Artificial Sequence: Synthetic peptide
MAGPAYPYDVPDYAPGLEASGGS

SEQ ID NO: 945 - protein, 15 aa, Artificial Sequence
  Description of Artificial Sequence: Synthetic peptide
KASGALEHHHHHHHH

SEQ ID NO: 946 - protein, 7 aa, Artificial Sequence
  Description of Artificial Sequence: Synthetic peptide
HHHHHHH

SEQ ID NO: 947 - protein, 7 aa, Artificial Sequence
  Description of Artificial Sequence: Synthetic peptide
MKHSGGS

SEQ ID NO: 948 - protein, 7 aa, Artificial Sequence
  Description of Artificial Sequence: Synthetic peptide
KASGALE

SEQ ID NO: 949 - protein, 45 aa, Artificial Sequence; identical to SEQ ID NO: 459
  Description of Artificial Sequence: Synthetic polypeptide
  MOD_RES (2)..(7): Variable amino acid and this region may encompass 4 to 6 residues
  MOD_RES (13)..(16): Variable amino acid and this region may encompass 2 to 4 residues
  MOD_RES (39)..(44): Variable amino acid and this region may encompass 4 to 6 resdiues

What is claimed is:

1. A polypeptide comprising a non-naturally-occurring monomer domain that selectively binds to IL-6, wherein the monomer domain is an LDL receptor class A monomer domain consisting of the following sequence $CX_2[A,P]X_4[E,Q]FX_7CX_9X_{10}GQC[I,L]$
$PX_{16}X_{17}X_{18}X_{19}CDGX_{23}[D,N]DCX_{27}DX_{29}SDEX_{33}X_{34}C$
(SEQ ID NO:3), wherein amino acids in brackets indicate alternative amino acids at a specified position;

$X_2$ is L, V, Q or E;
$X_4$ is D, G or S;
$X_7$ is R or P;
$X_9$ is G, D or E;
$X_{10}$ is N or S;
$X_{16}$ is L, A, Q or P;
$X_{17}$ is D, H or P;
$X_{18}$ is W or L;
$X_{19}$ is V or G;
$X_{23}$ is V or D;
$X_{27}$ is G, A, V, E, P or R;
$X_{29}$ is N, G or S;
$X_{33}$ is T, A, E or K; and
$X_{34}$ is G, S or D.

2. The polypeptide of claim 1, wherein the polypeptide comprises at least one and no more than six monomer domains that selectively bind IL-6.

3. The polypeptide of claim 1, wherein the polypeptide comprises at least two monomer domains that selectively bind IL-6.

4. The polypeptide of claim 1, wherein the polypeptide comprises three monomer domains that selectively bind IL-6.

5. The polypeptide of claim 1, wherein the polypeptide further comprises a monomer domain that has a selective binding specificity for a blood factor, thereby increasing the serum half-life of the polypeptide when the polypeptide is injected into an animal compared to the serum half-life of a polypeptide lacking the blood factor-binding monomer domain.

6. The polypeptide of claim 5, wherein the blood factor is serum albumin, an immunoglobulin or an erythrocyte.

7. The polypeptide of claim 5, wherein the monomer domain that has a selective binding specificity for a blood factor (i) binds to immunoglobulin (IgG) and (ii) is an LDL receptor class A monomer domain comprising a sequence selected from the group consisting of SEQ ID NOs:23 and 24.

8. The polypeptide of claim 5, wherein the monomer domain that has a selective binding specificity for a blood factor (i) binds to immunoglobulin (IgG) and (ii) is an LDL receptor class A monomer domain comprising SEQ ID NO:25.

9. The polypeptide of claim 5, wherein the monomer domain that has a selective binding specificity for a blood factor comprises SEQ ID NO:26.

10. The polypeptide of claim 1, wherein the polypeptide comprises SEQ ID NO:580.

11. The polypeptide of claim 10, wherein the polypeptide comprises a sequence selected from the group consisting of SEQ ID NOs: 6, 15, 271, 287, 296, 305, 314, 323, 332, 860, 861, 868, 872, 875, 876, 879, 880, 881, 898, 903, 905, 910, 913, 914, 921 and 922.

12. The polypeptide of claim 1, wherein the polypeptide comprises SEQ ID NO: 581.

13. The polypeptide of claim 1, wherein the polypeptide comprises SEQ ID NO:582.

14. The polypeptide of claim 1, wherein the polypeptide comprises SEQ ID NO:583.

15. The polypeptide of claim 1, wherein the polypeptide comprises SEQ ID NO:584.

16. The polypeptide of claim 1, wherein the polypeptide comprises SEQ ID NO:585.

17. The polypeptide of claim 16, wherein the polypeptide comprises a sequence selected from the group consisting of SEQ ID NOs: 8, 10, 17, 19, 273, 275, 289, 291, 298, 300, 307, 309, 316, 318, 325, 327, 334 and 336.

18. The polypeptide of claim 1, wherein the polypeptide comprises SEQ ID NO:586.

19. The polypeptide of claim 18, wherein the polypeptide comprises a sequence selected from the group consisting of SEQ ID NOs: 11, 20, 276, 292, 301, 310, 319, 328 and 337.

20. The polypeptide of claim 1, wherein the polypeptide comprises SEQ ID NO:587.

21. The polypeptide of claim 20, wherein the polypeptide comprises a sequence selected from the group consisting of SEQ ID NOs: 5, 14, 35, 270, 286, 295, 304, 313, 322, 331, 858, 871, 902 and 906.

22. The polypeptide of claim 1, wherein the polypeptide comprises SEQ ID NO:588.

23. The polypeptide of claim 1, wherein the polypeptide comprises SEQ ID NO:589.

24. The polypeptide of claim 1, wherein the polypeptide comprises SEQ ID NO:590.

25. The polypeptide of claim 24, wherein the polypeptide comprises SEQ ID NO:785.

26. The polypeptide of claim 1, wherein the polypeptide comprises SEQ ID NO:591.

27. The polypeptide of claim 26, wherein the polypeptide comprises SEQ ID NO:793.

* * * * *